United States Patent 7,745,391 (HUMAN THROMBOSPONDIN POLYPEPTIDE) - sequence listing, part 86

SEQ ID NO: 291898 - DNA, 4778 bp, Homo sapiens
  misc_feature (4253)..(4253): n is a, c, g, or t
  misc_feature (4264)..(4264): n is a, c, g, or t
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaaaaaaaaaaaaaaanaaaaaaaaaanaaaaaaaaaaaaaaaaaaaaacaaaaaaaaaaaaaaaaaacaaaaaaaaaaaaaaagaaagaaaagaaaaaaaacaacaaagacgggggggcgcaccacaaacaagcccaacaggagaacaaccataagcgacacgcagatagtgaaaaacgaggagggaccgccacaagaggggacgacgctaacaaaaaaagagcgaggaggcgccgacgggcgacaaacaaagagaggagaaggggagagaaacacacgcgacgcgaggacatgatgagaggaaagagagaccactatagcattggtggggggggaggaaataatgtgggaggcggaaccacaccgccacccacacgaaagacagaagaaaaccgcgacgaaggcagggaaaaaccaaacaacaactaccagcggagaaccgaggaggcggagagaaacagcaggcacaagcaccagatgaccgcgcgcagagaaagagagacgagaaagcgaaaagagtcaagcacggcaaaaatcacag

SEQ ID NO: 291899 - DNA, 3487 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291900 - DNA, 3216 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctggtatgctgttggcaggggacgtgggggtctcgggtagggagggcagtgtcctacaaaggtgggagtcagtggttggagcaccgtgaaaaccttgtctcgtgcagtctcagccgagacctcacctgcctgctgttacactttgcccaccttatgatgctcagcttctgccttccctgctcttggatgcctgctttccctttatcagcacccagtctttccatctgtatctcaggggcgttggtcctaagtttttctgggacttctcactgtcacactgcagggatgccttccaggtcatcttctctgactcttgttttctttggtttgttattttttcctccccaaaagcttgtccccacttgagaataaatatatcagaaccca

SEQ ID NO: 291901 - DNA, 2888 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggcccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291902 - DNA, 2697 bp, Homo sapiens
  misc_feature (2618)..(2618): n is a, c, g, or t
  misc_feature (2623)..(2623): n is a, c, g, or t
  misc_feature (2628)..(2628): n is a, c, g, or t
  misc_feature (2632)..(2632): n is a, c, g, or t
  misc_feature (2651)..(2651): n is a, c, g, or t
  misc_feature (2666)..(2666): n is a, c, g, or t
  misc_feature (2678)..(2678): n is a, c, g, or t
  misc_feature (2693)..(2693): n is a, c, g, or t
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttccagggtaacttgggccctttacaacttggaaaaagaattggggggggtcttgnaaggntaggnttgngggggagggaaaaccttcntttgaaaaccccaanagggaaaccccncttgcttcggggggngggc

SEQ ID NO: 291903 - DNA, 1510 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291904 - DNA, 917 bp, Homo sapiens
cacggtgccctgttcagccacaggccgagagaagcccactattaagtgggaacgggcaggtgggtacagtgccggcatagggtaggggcaggcaggcagttcactgatcagatacatacctgagggctgctgggtgccccgcactgtgccaggaaatgtggagattagacaagcagtgcagggctgatgtatagtttagttaggaaggaaaaagccagacacagaagaggtcagattatagccttggacaacatggaagacaactcaaggcaacaagtgattggattggttcagacagtgctgtaaagtcctctcttccccttttccaaaatagtttatcttttccaacataaaaattacatggaggccgtgcatagtggctcacgcctgtaatcccaacactttgggaagccgagatgggtgggtcacttgaggccaggagtttgagaccagcctggccaacatggtgaaaccccatctctactaaaaatgcaaaagttagccaggcgtggtggcacatgcttgcaatcccagctgcttaggaggctgaagcaggagaatcgcttgaacccaggaggtggaggctgcagtgggccgagatcatgccattgcaccagagtctggctgacagagtgagactctgactcaaaagaaaaaagaaacaaaagttacatgggctcctttacaaaatactggaagaggccgggcgtggtggctcacgcctgtaatcccagcactgtgggaagctgaggtgggtggatcacgaggtcatgagatagagaccatcctggctaacatagagtagtgaaacctcgtctctactgaaaatacaaaaaattagccaggggtggcggcacgcatctgtagtgccagctactcgggaggctgaggtaggagaattgtttgaacccaggagg

SEQ ID NO: 291905 - DNA, 956 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatgtgagagccaggggggctgtgcccagtccccctgtcagaccctcaatgactgaggcctgggggatccctcccttacctcagcttctcccatttccagttaaacgggccaggcagaatgcatttatcatcagctttttttgctcatgtggataagaggaaattaaaagttatattttttccaaaattttttccttcaagtctgggacccatttatctgctgcatgcttgtgcaaatggaaagggcggccgagcccttggccaagtgtcagacttgacctgccagggaccaggcaggcacttagtatctggtaactgtagccccagcctcagcctccagggcttccttgtgtctgttggcacagagcctcgaggttccacggcttcctgcttgtcctcc

SEQ ID NO: 291906 - DNA, 3194 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagagggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291907 - DNA, 3849 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccaatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291908 - DNA, 3470 bp, Homo sapiens
attcggaacgagggagtccttggccactggtccacttggggtctagaccaggattatagaggacacagcaagtgagtcctccccactctgggcttgtgcacactgacccagacccacgtcttccccacccttctctcctttcctcagccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagagcaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291909 - DNA, 3600 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaatgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291910 - DNA, 1662 bp, Homo sapiens
agcggggcgagagtggaagaccaggggacagaacagaaatccccatggtggccagagtgtcaggtctcatcgtgacgctcttgtcctcctccttcccaggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggcccctgccctagtgcaacaggcattgctgaggtctgagcagggcctggcctttcctcctcttcctcaccctcatcctttgggaggctgacttggacccaaactgggcgactagggctttgagctgggcagttttccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttggcccactggtcccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291911 - DNA, 2864 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggtgggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagccttttttacaa

SEQ ID NO: 291912 - DNA, 2719 bp, Homo sapiens
cggggactcggaggtactgggcgcgcgcggctccggggctcgggacgcctcgggacgcctcggggtcgggctccggctgcggctgctgctgcggcgcccgcgctccggtgcgctccgcctcctgtgcccgccgcggagcgcagtctgcgcgcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagctgcgccttcctcttcattccccagctggtccttgccctcaccccatggtcctcaaactgctgcttctcaaatccctagttctggggcaagagcgggcaggagtcctatcagtctttccattaacaagtacttacgcggctgggcacagtggctcacacttgtaatcccagcactttgggagactgaggcaggaggatcgcctgaggccaggagtccgagaccagcctgggcaacatagcaagactctgtctctacaaaaaaattaaaaacaaacaaacaagtacttatgaa

SEQ ID NO: 291913 - DNA, 1768 bp, Homo sapiens
tcaaggaacgaaggggccactgactcagagcggcaagtacagcgagtagtccgagagcgcccaccggcgggcggggcggctggtacggccgatcatgggcagtttctgcacgtagcgcgaggccgggctaggcccgtacggcgcggggaaggcagtctggaaaaggcgcccgcggcagcgcctcccagcctgccgcccggctatgatgaaacgaaagtgcggggcgccgcgcggggcgaaacggctcttctggaaaacgtcgcgggtgccggtcccggggccctgctgccggggtgccccgcgcgcccgatgcacgcgcggcaagggcctgctctcagaggcggcgggcccagaggccggcgcggggccgcctccgccgctgccccgggggctctcgtcgccgtgcgggctgactatggcgcttgccgtcagctgcggcatcttccgcaccgagtccggggctgccgccggctccttcttgtccccgggcggccgcggagccgtgggtgcaggctggccggtgccaaagcgtgtggccaagctgtcaccgaagaaggcgtagagctcccggtagatgtcggccagggtcaccgaaagagaagggtcctccggccccgcgccccctggcggcagcgggaggccggacccaaagctgggttctgcaccgcccccggaggacgactcttgaaagagaaggctgtcccatggcaggtcgtccaggcgccggcaccccctgccacctgggccacccctgttgggctctgctgcctgggccttcatcttcagcagtcgctctaccgccacctgtaagagccaaggactaagataggcaaaaaattcgaggaacctgggcccatcaaatattccaaagtaagcctgcttggctgctaagctcatgcagggaagggaggctggaaggggacggtactcaccagaatggctccatagactttgtgtccatctgctttgacctgggcattagatactgaataatcatccagcacagcctgcaagtttgtccagtaggtggacaggtgtgggtacaggactcgttctactgcctggaaggaagagaaggaatacagttagcatgtctttgatacttattccctctcaaggaccctttcccatgaaagacctacctttatctctgatcctagacagggctcaatcctcctaaattccctgattggcatattcaaccatatatttatttggaacctactgtatacctaagctaggcattgggaataaagataaggtacaaagggagacaataaaaaatatacccaatatcactgccctgtgtgctaaataatgctcattactgacaactccaaaatttagtttgcatactgctaccctatacaatcaggcaagtactggcttcacttagatgtaaactgagactcagttcaaacaatctgcataaaaacaaccaaccagagacttggactctgattatacaatttaaaatcctgtgattggacaggcgctgtggctcacgcctgtaatcccagcactttgggaggccgaggccagtggatcacctgaggtcaggagttcaagaccagcttggccaagatggtgaaaccccatctctactaaaaatacaaaaattagctgggcgcagtagcagttgcctgtaatctcaactacttgggaggctgaggcaggagaatcacttgaactcggggggcagaggttgcagtgagccgagatcacaccaccgcactccaccctgggaagcaaagtgagactccgtctc

SEQ ID NO: 291914 - DNA, 320 bp, Homo sapiens
atcagaaagatatgaaggactgggttgaagccctgaaccaagccagcaagatcaccgttcccaaaggtgggggcctacccatgaccactgaagttctcaagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgt

SEQ ID NO: 291915 - DNA, 1342 bp, Homo sapiens
agcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaggtttctacacatatagcctatagggttgtcgggttttacatctggaacaggctatgacgagtac

SEQ ID NO: 291916 - DNA, 1591 bp, Homo sapiens
agcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggtgagcgcgcggggcggggcctagggcagagcagggacggggctggggcagacaaaaggcccggggagggcagggttgtcgtctccgctagaagtaggcgagtgtgaaaccgcacaggggtaaattgagcctcagtcactcccacttccgccccaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgt

SEQ ID NO: 291917 - DNA, 1435 bp, Homo sapiens
agcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggtgcgccgcctactgctgctggtgcagggcaagggcgaggccgcctgccaggagctgctacgctgtgcccagcgtaccgcgggcgcgccggaccccgcttgggactggcagcacgtgggtccgggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgt

SEQ ID NO: 291918 - DNA, 1311 bp, Homo sapiens
agcctgaggaggagacaggacagagcgtctggagaggcaggaggacaccgagttccccgtgttggcctccaggtcctgtgcttgcggagccgtccggcggctgggatcgagccccgacaatgggcaacgcgcaggagcggccgtcagagactatcgaccgcgagcggaaacgcctggtcgagacgctgcaggcggactcgggactgctgttggacgcgctgctggcgcggggcgtgctcaccgggccagagtacgaggcattggatgcactgcctgatgccgagcgcagggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgt

SEQ ID NO: 291919 - DNA, 1132 bp, Homo sapiens
agcctgaggaggagacaggacagagcgtctggagaggcaggaggacaccgagttccccgtgttggcctccaggtcctgtgcttgcggagccgtccggcggctgggatcgaggctaccgggaccgcagctatgaccctccatgcccaggccactggacgccggaggcacccggctcggggaccacatgccccgggttgcccagagcttcagaccctgacgaggccgggggccctgagggctccgaggcggtgcaatccgggaccccggaggagccagagccagagctggaagctgaggcctctaaagaggctgaaccggagccggagccagagccagagctggaacccgaggctgaagcagaaccagagccggaactggagccagaaccggacccagagcccgagcccgacttcgaggaaagggacgagtccgaagattcctgaaggccagagctctgacaggcggtgccccgcccatgctggataggacctgggatgctgctggagctgaatcggatgccaccaaggctcggtccagcccagtaccgctggaagtgaataaactccggagggtcggacgggacctgggctctctccacgattctggctgtttgcccaggaacttagggtgggtacctctgagtcccagggacctgggcaggcccaagcccaccacgagcatcatccagtcctcagccctaatctgcccttaggagtccaggctgcaccctggagatcccaaacctagccccctagtgggacaaggacctgaccctcctgcccgcatacacaacccatttcccctggtgagccacttggcagcatatgtaggtaccagctcaaccccacgcaagttcctgagctgaacatggagcaaggggagggtgacttctctccacatagggagggcttagagctcacagccttgggaagtgagactagaagaggggagcagaaagggaccttgagtagacaaaggccacacacatcattgtcattactgttttaattgtctggcttctctctggactgggagctcagtgaggattctgaccagtgacttacacaaaaggcgctctatacatattataatatattcgcttactaaatgaataaggactttccaactgcgt

SEQ ID NO: 291920 - DNA, 977 bp, Homo sapiens
tagtagaaatggtgtttcaccatgttggccaggctggtcttgaactcctgacctcgtgatccacccacctcgacctcccaaagtgctgggattacaggcgtgaggcactataccaggcagggatacggtttttcaaactgcttctaagagaggtggacccagaaagcctctgacctgcaccggagctcttggcagacctggactgtttcagaaatgcattcttgggccccacaccagacaggcctagtcgggaactctggggaacgcagcactctggcctctaacagccaagccttctgggtgattctgacacatatcgaatctgggaatcactaggcctctgccttgtcttcagactgggagtgactaagaccagaaagccaaccgcctgccctccaaccgcctgccctccaaccgccagccctccaaccgcctgccctccaatagccagccctccaaccgcctgccctccaatcgccagccctcccggcttccatctcctcccagctacctgcagtgccaccaggtttatcaccttagagcatccacagccacagttacccagagagaagagaaggaggagacacagggcttggggacgaaggcattcaaacaggtaactgatgactgcaaactctgcgatctatctacaggcagcaaagtgttgctattacttaaaaacaaaaaaaaccccaggtagtcagtcttccctagaaaaggttccagaccttgttcttccataaatttggggagaggcagggtggtgctgagtcagagtaggaggtacctgcaggtttcaaggtctctgttcgtagcgttcggtaaggattcaaacgtcgtgataaagccttctgacctgtaccctctttcaaagaaagcgtgtcgtgggcacagagacagttttagtcggtagcttcggatttgcctgcttgagatcccgcaagcgccaggatcagccacacagccggcaacagccc

SEQ ID NO: 291921 - DNA, 771 bp, Homo sapiens
tagtagaaatggtgtttcaccatgttggccaggctggtcttgaactcctgacctcgtgatccacccacctcgacctcccaaagtgctgggattacaggcgtgaggcactataccaggcagggatacggtttttcaaactgcttctaagagaggtggacccagaaagcctctgacctgcaccggagctcttggcagacctggactgtttcagaaatgcattcttgggccccacaccagacaggcctagtcgggaactctggggaacgcagcactctggcctctaacagccaagccttctgggtgattctgacacatatcgaatctgggaatcactaggcctctgccttgtcttcagactgggagtgactaagaccagaaagccaaccgcctgccctccaaccgcctgccctccaaccgccagccctccaaccgcctgccctccaatagccagccctccaaccgcctgccctccaatcgccagccctcccggcttccatctcctcccagctacctgcagtgccaccaggtttatcaccttagagcatccacagccacagttacccagagagaagagaaggaggagacacagggcttggggacgaaggcattcaaacaggcaggtcctcccacgggaatcccgtgacggccgactccacgaccacttccccagcatgactagatttcctgcagcttcgaaatgcaaacattgcctcagacaaaagctaaaattgttacagtcagaaccgaaaccacgagtgagaaggggctctg

SEQ ID NO: 291922 - DNA, 2868 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291923 - DNA, 2310 bp, Homo sapiens
agcggccgcgcgggtgtttatgtcgggtcgcggggtctcgcggcacatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291924 - DNA, 2661 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291925 - DNA, 2406 bp, Homo sapiens
  misc_feature (2351)..(2351): n is a, c, g, or t
  misc_feature (2353)..(2353): n is a, c, g, or t
  misc_feature (2360)..(2360): n is a, c, g, or t
  misc_feature (2362)..(2362): n is a, c, g, or t
  misc_feature (2369)..(2369): n is a, c, g, or t
  misc_feature (2390)..(2390): n is a, c, g, or t
  misc_feature (2392)..(2392): n is a, c, g, or t
  misc_feature (2395)..(2395): n is a, c, g, or t
  misc_feature (2397)..(2397): n is a, c, g, or t
  misc_feature (2401)..(2401): n is a, c, g, or t
agcggccgcgcgggtgtttatgtcgggtcgcggggtctcgcggcacatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaaaaaaaaaaaaaaaaaaaaaaaaaacaaaaaaaaaaaaaaananaaacaananaaaaaanaacaaaaaaaaaaaaaaaagngnggngncgcncgccc

SEQ ID NO: 291926 - DNA, 2586 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcgacttcctgattctcccaggattcatagacttcatagctgatgaggtggacctgacctcagccctgacccggaagatcacgctgaagacgccactgatctcctcccccatggacactgtgacagaggctgacatggccattgccatggctaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291927 - DNA, 1813 bp, Homo sapiens
agcggccgcgcgggtgtttatgtcgggtcgcggggtctcgcggcacatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcgtaagtgtggtggcctccttgctgtcacttggaggcagtgggttgggcaggtggggccagggttctgaggtcaagctgaggttccagggaccccatggaccacctgcagcagggacagatgctgctgcaggatggcccctcaccctctcttcgggggcccagccccctgttccttgtcctttagtccccatgcaagcaggccctcccctcccctcgggcctctcccgagcagggcacaggaggt

SEQ ID NO: 291928 - DNA, 1013 bp, Homo sapiens
tgggcactgaggacatccactcagatgtggcgatggcccaaaggagcatggccatctctgcacccagcatggttcttcagggaatgctggcctgggggaggacagaggcctagggcctgctccaggccctcctcctgcgccgtacggctgagatctcagggcttctcagctctctgttctctcctacatctgggggccctggggaaagggttttgggaaggagcagggtccacacacccactcttgttccccctcttgccttgtccccacagttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291929 - DNA, 2760 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291930 - DNA, 2956 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcaggtggctccaactcctggggttcaaacagtgcttgctggagtcctgtccgactgacttggcttacccctccttagctgtttcctcctagaactatcttcagtggtcttactggcaggtgttggtgtccagatggatcgccttcgcagggctagcatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291931 - DNA, 2857 bp, Homo sapiens
tcggaaggggccaggagacactggaaggtccggacggcagggaaggggacggggttctttccagtcccacccgtgtagggacacctctccccctcatcccccgatgtaccctcgctgaatctgggatgggagagacgaaccgagtctaggcatctgcgtagcagcgccggggagagcggggagcccaggcggagcccagtcgactcccggattcccctgccccgcccccggcacgaggccccgccccggcgccccgcccctcctcgggactcgaccgggctgcgctcactgcccagccggggccccgggagcctccaggctcccgcccgccctgagctgcggcctccgcatggaggggccactcactccaccaccgctgcagggaggcggagccgccgctgttccggagcccggagcccggcaacacccgggacacgagacggcggcgcagcggtacagcgcccgactgctgcaggccggctacgagcccgagagccctagattggacctcgctacacacccgacgacaccccgttcaggtggctccaactcctggggttcaaacagtgcttgctggagtcctgtccgactgacttggcttacccctccttagctgtttcctcctagaactatcttcagtggtcttactggcaggtgttggtgtccagatggatcgccttcgcagggctagcgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctccataactgagtggtccacagatttgcactacgggttctccagctcctttccaggcagagaggaggggaggtcctgaggggactgctgcccctcactcggcatcccctgcagagtcaggactgctcccggggccaggctgccctgggagcccccctccgagcccagccagccaggctctcaggccctgcgcctgcctcaggtctttcttgctgcagcctgctccagcctggcccccaccccaggggcaggcggcccctcctggcttctcctgtagggcacctccctgcccctagcctcccaggaaatggtgctctcctggccctgcctctggcccttcccgggccgctgcccctcagccatgtggcacttctgagctcctgacctaggccaaggggaggtctctgcccccttccccggccctgggctacccttgggtcctgctcctcaggccgctcccctgtccctggccatgggtaggagactgccctggtcatggccgcctgcctgtcattcctgactcaccaccgtccccaggtgaaccattcctcccttctcctcagctgcagtcgaaggctttaactttgcacacttgggatcacagttgcgtcattgtgtattaaatacttggaataaatcaagcaggtctcaa

SEQ ID NO: 291932 - DNA, 1762 bp, Homo sapiens
agcggccgcgcgggtgtttatgtcgggtcgcggggtctcgcggcacatggcggactacctgatcagcggcggcaccggctacgtgcccgaggatgggctcaccgcgcagcagctcttcgccagcgccgacggcctcacctacaacgacttcctgattctcccaggattcatagacttcatagctgatgaggtggacctgacctcagccctgacccggaagatcacgctgaagacgccactgatctcctcccccatggacactgtgacagaggctgacatggccattgccatggctctgatgggaggtattggtttcattcaccacaactgcaccccagagttccaggccaacgaggtgcggaaggtcaagaagtttgaacagggcttcatcacggaccctgtggtgctgagcccctcgcacactgtgggcgatgtgctggaggccaagatgcggcatggcttctctggcatccccatcactgagacgggcaccatgggcagcaagctggtgggcatcgtcacctcccgagacatcgactttcttgctgagaaggaccacaccaccctcctcagtgaggtgatgacgccaaggattgaactggtggtggctccagcaggtgtgacgttgaaagaggcaaatgagatcctgcagcgtagcaagaaagggaagctgcctatcgtcaatgattgcgatgagctggtggccatcatcgcccgcaccgacctgaagaagaaccgagactaccctctggcctccaaggattcccagaagcagctgctctgtggggcagctgtgggcacccgtgaggatgacaaataccgtctggacctgctcacccaggcgggcgtcgacgtcatagtcttggactcgtcccaagggaattcggtgtatcagatcgccatggtgcattacatcaaacagaagtacccccacctccaggtgattggggggaacgtggtgacagcagcccaggccaagaacctgattgatgctggtgtggacgggctgcgcgtgggcatgggctgcggctccatctgcatcacccaggaagtgatggcctgtggtcggccccagggcactgctgtgtacaaggtggctgagtatgcccggcgctttggtgtgcccatcatagccgatggcggcatccagaccgtgggacacgtggtcaaggccctggcccttggagcctccacagtgatgatgggctccctgctggccgccactacggaggcccctggcgagtacttcttctcagacggggtgcggctcaagaagtaccggggcatgggctcactggatgccatggagaagagcagcagcagccagaaacgatacttcagcgagggggataaagtgaagatcgcgcagggtgtctcgggctccatccaggacaaaggatccattcagaagttcgtgccctacctcatagcaggcatccaacacggctgccaggatatcggggcccgcagcctgtctgtccttcggtccatgatgtactcaggagagctcaagtttgagaagcggaccatgtcggcccagattgagggtggtgtccatggcctgcactcttacgaaaagcggctgtactgaggacagcggtggaggccgaggtggtggaggggatgcaccccagtgtccacttttgggcacagcctccctcccttctcctcagctgcagtcgaaggctttaactttgcacacttgggatcacagttgcgtcattgtgtattaaatacttggaataaatcaagcaggtctcaa

SEQ ID NO: 291933 - DNA, 728 bp, Homo sapiens
cggacgcgtgggtcgacccacgcgtccggggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291934 - DNA, 975 bp, Homo sapiens
ggacgcgtgggtcgaccacgcggtcgcccacgcgtccgggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaaaaaaaaaaaaaaaagaaagaaaaagaaaaagaaaacagaggaaagaaagaaagtaaaagaaaaagattaagaaaatctaacgaggtaaatagaataggcgagaaaaaaaacacagacagacaccagctacgcactatataagtcgagggaggagcaaagcgtagtatagaagagagactgcacaaaaaaaaggctcgagataaaagaacatgtgaagacagagggac

SEQ ID NO: 291935 - DNA, 593 bp, Homo sapiens
aggagggtgaggacgtacaaggagcatcgcaggcgaggaaacaacacaacggccaggacctaactgtggtgggaactgcctttgtctccacacactcgcaatcaacatgcgtatttgctattctcaaacaactcccttccacccccttaggctgaaaggacaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcttttgtgcaaggcaaaatatgcgtg

SEQ ID NO: 291936 - DNA, 1179 bp, Homo sapiens
aatttgaaaaccccatgggacctgagtcaaaccgatccagggctgctgctgtccctcccggctgtgtggtgttgagtggcgtcctgagttaggcttctccctacttcatctcatacccccatcaccagccctgcgcaggtgccaagtgatgcccacccagctgccccactttgcagattcggaaactgagcccagagatgggaaaggacttacccaagggcctctgactgctggactgtttctctttcccctgaacctcgagctgaggccacgttagagccgacaccttcatattcaatgttcagtgattattgtgtacagcgagtgtcctgctcttgaaaaattgtcaaaagcacagcagcagctagggaattcccgccctccagctggatttaccggtacatactaggggtcacagaaggaatttgatttcataacagcgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctggaggcggacactgcgtgagggtcagtttttgcccctgcttccctgtggtgtctggctcccagcagcgtcagggagggtccgtggagtggctgagtttggatctaggtggttggcattaaaatctccctggctttgggttttcttttttgagacagagtcttgctctgtagcccaggctggagtgcagtggtgcgatctcagctcactggaacctccgcctcccaggttcaagcaattctcatgcctcagccttcaagtagatgggattacaggtgcctgccaccatgcccagctaatttttgtattcgtattagagactgggtttccccatgttggccaggctagtctcgaactcctgacattaagtgatccgcctgcctcggcctcccagagtgctgggattgcaggtgtgagccactgcgcccggcccctggctttgggttttctgctcaccttcctccttccctcccacaaatactatgtgtcccaaatgtgccgggatccatgccttgtgctggggacacagaggggaccgatgccatcctggtcatggg

SEQ ID NO: 291937 - DNA, 572 bp, Homo sapiens
ggtggcgggggcctgtaatctcagctactcgggaggctgaggcagtagaattgcttgaaccggggaggcggaggttgcagcgagctgagatcgcgccattgcactccaggctgggcaacaacagtgacttgtctcaaaaacaatagcaacaacaacaacaaaaaacaaaactgaaggtgggactgggaagacgtttgggaaagcagcctcgggtgaaggaggtggaatgagttctacgtcttgactttggggtgccgtggcaggcagcgtggaggttgcctgtcgttcaggttggaggagcctgcccgggctgaggtggccagctggggcccagagccagaacacttgggaggggtggagaggaagcagcagcccttggagaggaagtgattcaaaaccacgtatgcctggatgtgtccggactacggcaacatctgcccaactgccttctcctggcccctgtgggcactccccttccagtagctggagagaccttcccggacagatcatgagcatgccccacacctctccctcgggatcaggttcaagctcaacttcctggctagcctctc

SEQ ID NO: 291938 - DNA, 768 bp, Homo sapiens
aatttgaaaaccccatgggacctgagtcaaaccgatccagggctgctgctgtccctcccggctgtgtggtgttgagtggcgtcctgagttaggcttctccctacttcatctcatacccccatcaccagccctgcgcaggtgccaagtgatgcccacccagctgccccactttgcagattcggaaactgagcccagagatgggaaaggacttacccaagggcctctgactgctggactgtttctctttcccctgaacctcgagctgaggccacgttagagccgacaccttcatattcaatgttcagtgattattgtgtacagcgagtgtcctgctcttgaaaaattgtcaaaagcacagcagcagctagggaattcccgccctccagctggatttaccggtacatactaggggtcacagaaggaatttgatttcataacagcgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctggaggcggacactgcgtgagggtcagtttttgcccctgcttccctgtggtgtctggctcccagcagcgtcagggagggtccgtggagtggctgagttgaaccagtggctgcagcatggggatactctagaacagctcatgcacg

SEQ ID NO: 291939 - DNA, 462 bp, Homo sapiens
tctagaagttttacagtttcaggtcctgtgtttaagtctttaatccatgggtagatggcaaaaaggacgaagtcaggatctcaaagaggtatctgtacccccgtgttcactgaagcattattcataatggccaagatacggaaacaactcatgtgtctactgacagaagaatggatcaagaaaatggagtatattctgaccgggcacgctggctcacgcctgtaatcccatcaatttaggaggccaaggcaggtgaatctcttgaggccaggagttcgagaccagcctcggcctcccagagtgctgggattgcaggtgtgagccactgcgcccggcccctggctttgggttttctgctcaccttcctccttccctcccacaaatactatgtgtcccaaatgtgccgggatccatgccttgtgctggggacacagaggggaccgatgccatcctggtcatggg

SEQ ID NO: 291940 - DNA, 481 bp, Homo sapiens
tctagaagttttacagtttcaggtcctgtgtttaagtctttaatccatgggtagatggcaaaaaggacgaagtcaggatctcaaagaggtatctgtacccccgtgttcactgaagcattattcataatggccaagatacggaaacaactcatgtgtctactgacagaagaatggatcaagaaaatggagtatattctgaccgggcacgctggctcacgcctgtaatcccatcaatttaggaggccaaggcaggtgaatctcttgaggccaggagttcgagaccagcctggccaatgtggcaaaaccctgtctctactaaaaatacaaaaattagccgggcgtggtggcaggctcctgtaatcccagccactaatcgggaggctgaggcacgagaatcacttgaaccagggaaccagggaggtggaggttgcagtgagccaagatggtgccactgcactctagcctgggcgacagagcgaga

SEQ ID NO: 291941 - DNA, 2713 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291942 - DNA, 2738 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcttttgtgcaaggcaaaatatgcgtg

SEQ ID NO: 291943 - DNA, 2747 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgctttgttgccacagtcgcgttgtcggtgatgcgca

SEQ ID NO: 291944 - DNA, 2719 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagaaagatggctgatgggaggcaagatctggattcaggaatcctcaattttagctctcgctctgtcaccaaaaccctccatcccgtcgacgcggccgcgaatttagtagtagta

SEQ ID NO: 291945 - DNA, 2015 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggtacttggcggggggggggcgtcctgatcacggaaacaccggctttggaacttaccttgtaacccgccgggccctggctgttgcgccaccctgtggcacagacccgggcccaggtc

SEQ ID NO: 291946 - DNA, 2065 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcaaaaacaatagcaacaacaacaacaaaaaacaaaactgaaggtgggactgggaagacgtttgggaaagcagcctcgggtgaaggaggtggaatgagttctacgtcttgactttggggtgccgtggcaggcagcgtggaggttgcctgtcgttcaggttggaggagcctgcccgggctgaggtggccagctggggcccagagccagaacacttgggaggggtggagaggaagcagcagcccttggagaggaagtgattcaaaaccacgtatgcctggatgtgtccggactacggcaacatctgcccaactgccttctcctggcccctgtgggcactccccttccagtagctggagagaccttcccggacagatcatgagcatgccccacacctctccctcgggatcaggttcaagctcaacttcctggctagcctctc

SEQ ID NO: 291947 - DNA, 3266 bp, Homo sapiens
ccacctgttctctgggtgcagggaaaactcttcccgccctcccagctgcttttgcctttgggcgggagccctggacgggggactcgccggacggtggggcgaggcccggggggcgtcgcacgcgggaagcagagcccggcgggggaggtggggagccgtcctggcgccgcgcgattagccgcatctgggggaggaggagccgccgggcgcgctgggcccgggtgtttgcgcccggatgggggtgggggtgccctaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291948 - DNA, 2783 bp, Homo sapiens
ggtcatgcgggtgccctggcccccaggccagcagctggggcctttttgaggtgggggctccccggactcaggagttcctccttggccgcggctgtagctgagagaagggacaggaggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291949 - DNA, 3012 bp, Homo sapiens
ggtcatgcgggtgccctggcccccaggccagcagctggggcctttttgaggtgggggctccccggactcaggagttcctccttggccgcggctgtagctgagagaagggacaggaggtaggatgccacctcctccagaagcgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291950 - DNA, 3471 bp, Homo sapiens
ccacctgttctctgggtgcagggaaaactcttcccgccctcccagctgcttttgcctttgggcgggagccctggacgggggactcgccggacggtggggcgaggcccggggggcgtcgcacgcgggaagcagagcccggcgggggaggtggggagccgtcctggcgccgcgcgattagccgcatctgggggaggaggagccgccgggcgcgctgggcccgggtgtttgcgcccggatgggggtgggggtgccctaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacaccgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291951 - DNA, 3312 bp, Homo sapiens
aatttgaaaaccccatgggacctgagtcaaaccgatccagggctgctgctgtccctcccggctgtgtggtgttgagtggcgtcctgagttaggcttctccctacttcatctcatacccccatcaccagccctgcgcaggtgccaagtgatgcccacccagctgccccactttgcagattcggaaactgagcccagagatgggaaaggacttacccaagggcctctgactgctggactgtttctctttcccctgaacctcgagctgaggccacgttagagccgacaccttcatattcaatgttcagtgattattgtgtacagcgagtgtcctgctcttgaaaaattgtcaaaagcacagcagcagctagggaattcccgccctccagctggatttaccggtacatactaggggtcacagaaggaatttgatttcataacagcgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291952 - DNA, 3411 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgtgagtctggagcaggctggggacgcgttctcagatggatctcttgcctgaggccagagattcactgtgtctctggccatttttgggcctatgtcccggactgccaaataggcagacctggggctgggccgtgggctgagggtgagaaactaggaaggcgccttgtaaattcagggtactgcccagcccagaagaacctgttaccagctgggagtggcaatgggtgggcagttgctggggtcagaatcgctgggctttaaccacacatgagagtctggttccctgtgagactgtgaattctgcagctgcaaaatgggcacagcaccagggctgcaaaggacccacataatgcctggcagatgcaggtctcaggccttgcgagtggaggatgcttgtgttattaatagtaaatcattagtttctggagggatgttcagtgatgttttagttcaactccctctttccaggagggaaaacaggcccgagaaaattggccagggtcatccaaagagtcctttcccccagcgtctttgtgagcggctcccagggttgagggttgtgcagtcctcagcctgtgtgactgtacatggcggtcctggccagggcttgatggggcacagctgtgggcaggggctggaatgagctttgtgtgcccaggagcgctgatggggcccctgacatttccccctctctgtcaggacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291953 - DNA, 2655 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctatctcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291954 - DNA, 2897 bp, Homo sapiens
aatttgaaaaccccatgggacctgagtcaaaccgatccagggctgctgctgtccctcccggctgtgtggtgttgagtggcgtcctgagttaggcttctccctacttcatctcatacccccatcaccagccctgcgcaggtgccaagtgatgcccacccagctgccccactttgcagattcggaaactgagcccagagatgggaaaggacttacccaagggcctctgactgctggactgtttctctttcccctgaacctcgagctgaggccacgttagagccgacaccttcatattcaatgttcagtgattattgtgtacagcgagtgtcctgctcttgaaaaattgtcaaaagcacagcagcagctagggaattcccgccctccagctggatttaccggtacatactaggggtcacagaaggaatttgatttcataacagcgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291955 - DNA, 973 bp, Homo sapiens
agcggagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgacggtgcgggcttcacagggccccgtctacaaaggagtctgcaaatgcttctgccggtccaagggccatggcttcattaccccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcggggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaaaaaaaaaaaaaaaagaaagaaaaagaaaaagaaaacagaggaaagaaagaaagtaaaagaaaaagattaagaaaatctaacgaggtaaatagaataggcgagaaaaaaaacacagacagacaccagctacgcactatataagtcgagggaggagcaaagcgtagtatagaagagagactgcacaaaaaaaaggctcgagataaaagaacatgtgaagacagagggac

SEQ ID NO: 291956 - DNA, 2011 bp, Homo sapiens
gctaggtacgagctggtgtggaatcggcaccgaggaaagaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291957 - DNA, 1422 bp, Homo sapiens
tagctagtacgaggctggggttaatcggccgaggggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcaggtgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagagggaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291958 - DNA, 1959 bp, Homo sapiens
ccacctgttctctgggtgcagggaaaactcttcccgccctcccagctgcttttgcctttgggcgggagccctggacgggggactcgccggacggtggggcgaggcccggggggcgtcgcacgcgggaagcagagcccggcgggggaggtggggagccgtcctggcgccgcgcgattagccgcatctgggggaggaggagccgccgggcgcgctgggcccgggtgtttgcgcccggatgggggtgggggtgccctaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacaccgtggtgacccgggctgtgtggaaattcactgggcctgatggagctggatgcagccttggaaattctccctttccctttgggctcccgcagcaggccccccagtcctgggtgcaggcttgtgacagctgctcagggatccaaacgtggcgcttgagctctctgcgatgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcgcggcaacgtggtcccaagcccactgcccactcgccggacgaggaccttctcggcgtgagtctggagcaggctggggacgcgttctcagatggatctcttgcctgaggccagagattcactgtgtctctggccatttttgggcctatgtcccggactgccaaataggcagacctggggctgggccgtgggctgagggtgagaaactaggaaggcgccttgtaaattcagggtactgcccagcccagaagaacctgttaccagctgggagtggcaatgggtgggcagttgctggggtcagaatcgctgggctttaaccacacatgagagtctggttccctgtgagactgtgaattctgcagctgcaaaatgggcacagcaccagggctgcaaaggacccacataatgcctggcagatgcaggtctcaggccttgcgagtggaggatgcttgtgttattaatagtaaatcattagtttctggagggatttgtttgagaatagcaaatacgcatgttgattgcgagtgtgtggagacaaaggcagttcccaccacagttaggtcctggccgttgtttcctcgcctgcgatgctccttgtacgtcctcaccctcctctcccgcctctgccttctgctgggtcaaaggtggcctttttctctccagccttgaattgttccctgttggcttcccaagggcccatctgctggtacagtccacacttccaaagccaagacccgagagggctttcactgccccaagcctctctcctgtgaccttgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgc

SEQ ID NO: 291959 - DNA, 1848 bp, Homo sapiens
ggcacgagtggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagaggtgggggtctcgctatgttgcgcaggctggtcttgaactgctggcctaaagcgatccccccgcctaggcctcccaaagtgctgggtttaccagcgtgagccaccacgctgggcttcctgcatccttttaaggttcctgagggtctgcctgagaggagctgtccctgaatctccatgcagccccacctgccacatcaccaagacatacaatctttgccagcaacacttcctccttgcagattacaagcatagctaatgccaccaccagacaagaccgattcgctggcctccatttcttcaacccagtgcctgtcatgaaacttgtggaggtcattaaaacaccaatgaccagccagaagacatttgaatctttggtagactttagcaaaaccctaggaaagcatcctgtttcttgcaaggacactcctgggtttattgtgaaccgcctcctggttccatacctcatggaagcaatcaggctgtatgaacgagggcctcctggctttccctgtgggcttctgagaaaggtttctggaactcccaccacccccactacagtcccagccagagcaattgcatggccggcccagattgatatcctggatctctgcttttgattaaaaggtgacgcatccaaagaagacattgacactgctatgaaattaggagccggttaccccatgggcccatttgagcttctagattatgtcggactggatactacgaagttcatcgtggatgggtggcatgaaatggatgcagagaacccattacatcagcccagcccatccttaaataagctggtagcagagaacaagttcggcaagaagactggagaaggattttacaaatacaagtgatgtgcagcttctccggttctgagaagaacacctgagagcgctttccagccagtgccccgagtgcctgtgggaatgctctttggtcagacattccctcacacagtacagtttaataaatgtgcattttgattgtaaaaaaaaa

SEQ ID NO: 291960 - DNA, 952 bp, Homo sapiens
ggcacgagtggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgtttgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagttgccaggaattcttgccactttgctgctgtttatcaagctgggctgacacccaggcctggagaagatgagacacctgggcccatctggctgctggagattcagtctcagttttatttctctgtggcactcactgcttctggaggggagactgttaataaaagatttgggaacccccaaaca

SEQ ID NO: 291961 - DNA, 1070 bp, Homo sapiens
ggcacgagtggacaaccatcagggagccaggacacagaggggcagagcaagtcagcattggcgccccttcctcagatccctatcatcttgggaaacagtagcccagaggttcaggaagatgttaacttaaatgttcggggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgtttgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagaaactgaggctcggggaggggacatcactagttcaagatcacagagctttggcagagttggaatttgaagccccattggcctgagtccattgccggcaccacactacctgccttctagagaccctaaatggagcaataaccatgaaaagtgatcatcctagcgggagtgagggccagccacgtgatggagcactcactttggctgtttccataaactcctaaaaatcaccaagactcagagcttcaccctgagtgggagctctctgggagctgcagtgatacaggtaagacccagcctctctagggtctttgagctgttttattaagcacctactgtatgccaaacactgttctggtcactgggacacaggagtgaacaaaact

SEQ ID NO: 291962 - DNA, 448 bp, Homo sapiens
gcggagagagaggcaggtctagatgcagatggtctgtttcccctaacaacagcaacggcggcgaggagaaatcctggtctccgccagctcccggccagactcgtaatcaggccactaacgacagcggggagcgtaaaagttctcttccctacccacctcgcgtgatgcggtgacacagaatgaaattcacaacacacatggagaaaaggaaaacaaccaatccttccccagaacggaacagctaagagccaacgctactgaaaaccatggggcaggcatctccaccgagtgcagggaagaggccaggagaagacccaggaaataaatttaaaaagggacagcctttgagctggtccctgaccgagaattccacataagagattccatttacctacttcaataacatggatcgtaaaactcttattcaataaagatatgaaatagaaga

SEQ ID NO: 291963 - DNA, 492 bp, Homo sapiens
gcggccgctcctacctcccctcacctactctgtccccacccccactccgctcccacctcccgcccgccacgggccggttacctgctcgtcgaagcggctgaccacggcctggacccattccaccggcctgtgcgcggccatgtcctccccgcggccggggggcggcggagggaagggtgggccggcgccctgggccgggaagagggcggggagcggaggctgagagacaaggtctgactctgtgcagtggagtgcagtggctcaatcatagctcactccagcctcagactcctgggccgaagtgatcctcccacctcaagctcctgaatagctgggactacagctgggcatggtggcatgtgcctgtggttccagttacttgggaagctgaggtgggaggatcgcttgagcccaggaggtcaaggctacagtgagctgtgatggtgtcattgcattccagcactccagcccgggcatcagagttagaccttg

SEQ ID NO: 291964 - DNA, 563 bp, Homo sapiens
ggatcattttcttcttccggaagaagaaaatgatccggatcattttcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaaatgatccggatcattttcttcttccgggatgtctttttttctgacctgtgtttgccctctacttgtgaccactgcacatgtcgacagtaggtagctgaatggtggaagaaaaacaagaaggggtctacataaggggaacatcatttaaagctcataagatccccttgtggccggaagaagaaaatgatccgggg

SEQ ID NO: 291965 - DNA, 1199 bp, Homo sapiens
ggcgatgacattattaactctgcacacgtcagatctcgattccccaagagacgctgtcggctctggtcccacgggtgggcccgctcccctgcagacacactcaccttattcctgattttgacgcgctggtacaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291966 - DNA, 1061 bp, Homo sapiens
aagcctccctggcctccacagagtccactgctccctcttctgtgcccctcagtccctgggctccccccaccttcagccctgaccaccttgtggtgttcttgtcaaaatccccagtaaaatccgacattcctgagacaggtgatcaaacacttactgagtgcctactgtgtgcaggcgcacatttggtgctttaacatgttactgcatttagggcacacaatcatactatgaagggggtgtttgtactcccaacttacgggtgagcaatttgaggttcaggccacgtgtcttgcgggacacaggtgttgggtggggaagccaggattgaagcccaaactggttggttttcaaagcccatgatcttaggcacactgtcccacactccaaaggtattttacatattgtgtgtgtacacatttgtatatgcatgtgcatatgtgtgtgcatgtgcatgtgaactccgcaagctggatttacttccctcattggcgataggtggatctgaagggggggggggtggtgtgcagaggttcttaattttaatctttcaaaaccaaccatccattctacttttacctattctcttgcataaagatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacgtaagtaagttagctcactgcaaccacagcattatcagtactgcacaaagccctcttcggcacacagcacaagcaccatcctataaaatctccagcaagcctttgtttccttgcagtcggctcctttcttgctgacctacccactgtaccctttcatactttttctaatacatctgactttctttaccgaaaaaaaaacacaagggcggccgct

SEQ ID NO: 291967 - DNA, 610 bp, Homo sapiens
aaagggatttaaaaaagaaacgcacacaaacaagaaacaaaatgcacaatcctagcaagcaggattgttgaagtgagtaaccacatgcctgctctgtccctctgtcccgagttcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggtaagaccagcatggtggccccacccattccagacaggcggtgcccctgcagcaggccccagcttccagcaggtttgccagaacccgaatcctatcacccttggtgctgcagggtgcggtattcattcgccggggctgccatagcaaggtcccacagaccgggcagcttacac

SEQ ID NO: 291968 - DNA, 353 bp, Homo sapiens
ggggcctaatgggaggggtttgggtcatgaaggacagaccactcatgaatggcttggtgtcagccttacagtaatgagtaaattcttgctctattagctctcggaagaactggttgttaaagagcacctctgccttcttcctctgttgccatgtgatctctttcgctcccgactggactcctatgttcgctctctgcccttcttctccgcccgggctggctgaagcaacctacctcaaggtctcaggagaattcatgtctgcctggggcccttccgaacctgtgccaactaagggcccccactgagccgcccgcgccctcttcccagcccaggggaccatctagaacaccgca

SEQ ID NO: 291969 - DNA, 7855 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291970 - DNA, 8039 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcagtgcaaagcatctgtgcgacttggtgtctttgacctggtgctacaccttatggaagctggggagagaccaaaaccagatgcagagcctcccagtccgggctggagcctgggaatgcaggaaggtctctggacttctccatctcaattggtcacttaggaagcatacaaagaacaggaccacacaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291971 - DNA, 7574 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291972 - DNA, 6918 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcagggccagacccgagggtttctgagccgtgactctggctaagcccttcactgctctgggctgcaaaaggaggatcacagcacctcccgtgggtgggcaggattacttaagatgacgcaggacagcgccca

SEQ ID NO: 291973 - DNA, 4634 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccaggcgtagtgtatgctcggatt

SEQ ID NO: 291974 - DNA, 7085 bp, Homo sapiens
ttctagaggatcccggtatccccatacagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291975 - DNA, 7348 bp, Homo sapiens
gaaacgtcatttttatttctctcccttccctctctccattggttttctcttggaagtcccaggcacctatgtctctgacaccaactgttctcttatggccattagtgggtttcaaacagctcatttgatcccttcttataaacctggagtgagcgtaaggacctcagcatgctgcagaatgagagtttgaggcagggtgtgctgtggcttgtactgatgagggacgtgccaatattcttactcttcatttccgataccctgaaagtcttttccgcttctcattttattttgcagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291976 - DNA, 4233 bp, Homo sapiens
aatcgagctcgccccggttattttcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291977 - DNA, 3832 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggataaggcaactgctaacaaccttcacaggagaactttggcaataaca

SEQ ID NO: 291978 - DNA, 2116 bp, Homo sapiens
aagcctccctggcctccacagagtccactgctccctcttctgtgcccctcagtccctgggctccccccaccttcagccctgaccaccttgtggtgttcttgtcaaaatccccagtaaaatccgacattcctgagacaggtgatcaaacacttactgagtgcctactgtgtgcaggcgcacatttggtgctttaacatgttactgcatttagggcacacaatcatactatgaagggggtgtttgtactcccaacttacgggtgagcaatttgaggttcaggccacgtgtcttgcgggacacaggtgttgggtggggaagccaggattgaagcccaaactggttggttttcaaagcccatgatcttaggcacactgtcccacactccaaaggtattttacatattgtgtgtgtacacatttgtatatgcatgtgcatatgtgtgtgcatgtgcatgtgaactccgcaagctggatttacttccctcattggcgataggtggatctgaagggggggggggtggtgtgcagaggttcttaattttaatctttcaaaaccaaccatccattctacttttacctattctcttgcataaagatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291979 - DNA, 2238 bp, Homo sapiens
tactaaattagcgaccgcgtcgaccttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291980 - DNA, 2260 bp, Homo sapiens
gtcgcgctcggagcgcgtatattatttgggatatgtgtcacataggtcccttgctgatggagagtgcgactgactcgtcccgcgggaaaccctgatacttgtgacgtagtgtataagatcatagtggattcgccctcttagtactgcagctcataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291981 - DNA, 1542 bp, Homo sapiens
ggcatgaaggaatccctgtgcaatgggaccccccgatcctattgctcctgcaaattgctgtcttggcatttggggtcagatatctgccctcacggaagctgactgttaaccgcaggcctcagcttcagaccaagaaggaaatgaagccagccaaggggtgtgtctgcctcttcagtgggtgtcccagccagggatttccatgagtccccttgtcctcatatggcctgctgcctgtgcctggccttgtctcggatctgacttgtttccaccccatcccttgtttccccatccagtgcaaagcatctgtgcgacttggtgtctttgacctggtgctacaccttatggaagctggggagagaccaaaaccagatgcagagcctcccagtccgggctggagcctgggaatgcaggaaggtctctggacttctccatctcaattggtcacttaggaagcatacaaagaacaggaccacacaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291982 - DNA, 557 bp, Homo sapiens
ttctagaggatcccggtatccccatacagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggtaatgctggagggggcgggagggaacataaagatattcagacta

SEQ ID NO: 291983 - DNA, 456 bp, Homo sapiens
tcaaaggaggaaacgtcatttttatttctctcccttccctctctccattggttttctcttggaagtcccaggcacctatgtctctgacaccaactgttctcttatggccattagtgggtttcaaacagctcatttgatcccttcttataaacctggagtgagcgtaaggacctcagcatgctgcagaatgagagtttgaggcagggtgtgctgtggcttgtactgatgagggacgtgccaatattcttactcttcatttccgataccctgaaagtcttttccgcttctcattttattttgcagtgtagacgttgacctgtgtatctacagccttcacttaaaagacctgctgcatttggacacggcactgaggcaggaaaagcatatggtaggtggagatgttcgcattccctccttttcatggggacaggagctgggagacaaggactctgtgtg

SEQ ID NO: 291984 - DNA, 178 bp, Homo sapiens
ggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtacgggaccccccctcagggaagccccagaaga

SEQ ID NO: 291985 - DNA, 7602 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291986 - DNA, 6431 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcaggtaccctgcctccattttggttaccatccccacttattatgggctgtgggctgttatggtgatggatggatgtggatttggaaggggaccatgagagatgatgtattatgatgaactcatgatttaattctttggtgaaaat

SEQ ID NO: 291987 - DNA, 805 bp, Homo sapiens
ggcatgaaggaatccctgtgcaatgggaccccccgatcctattgctcctgcaaattgctgtcttggcatttggggtcagatatctgccctcacggaagctgactgttaaccgcaggcctcagcttcagaccaagaaggaaatgaagccagccaaggggtgtgtctgcctcttcagtgggtgtcccagccagggatttccatgagtccccttgtcctcatatggcctgctgcctgtgcctggccttgtctcggatctgacttgtttccaccccatcccttgtttccccatccagtgcaaagcatctgtgcgacttggtgtctttgacctggtgctacaccttatggaagctggggagagaccaaaaccagatgcagagcctcccagtccgggctggagcctgggaatgcaggaaggtctctggacttctccatctcaattggtcacttaggaagcatacaaagaacaggaccacacaggtacacacatggccacacacacagagctcaccacatgctcgcatacacacacgcgcacacacacacactccaacacacgcacacacatccccatatgcacacatacacacgtgcatgcatgtacacatgcacacatgacacgcatagacatacacacatgtgcgcgtgcacacacacacacacacacacgaagctggcctttctggcaaacatcagctgtctcatggggaaagcagctgccatggggatgggagggcctggctggggaagatgttggccacgggcgggagtctctctcagctgtgagaaagttccctcctctgagttg

SEQ ID NO: 291988 - DNA, 6800 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacgtaagtaagttagctcactgcaaccacagcattatcagtactgcacaaagccctcttcggcacacagcacaagcaccatcctataaaatctccagcaagcctttgtttccttgcagtcggctcctttcttgctgacctacccactgtaccctttcatactttttctaatacatctgactttctttaccgaaaaaaaaacacaagggcggccgct

SEQ ID NO: 291989 - DNA, 4944 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactccggtggggtgccgagctcgattg

SEQ ID NO: 291990 - DNA, 4163 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggaagaagaaaatgatccggatcattttcttcttccgggatgtctttttttctgacctgtgtttgccctctacttgtgaccactgcacatgtcgacagtaggtagctgaatggtggaagaaaaacaagaaggggtctacataaggggaacatcatttaaagctcataagatccccttgtggccggaagaagaaaatgatccgggg

SEQ ID NO: 291991 - DNA, 7563 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactatgtaaaattctagcagcaaacccagtgcctggagctcaacaaatatttattaaatgagtaaatcatgaagggtggataatgctgaaaggtgggaaggatagagtccttatcagggaggggaagttgagccggcggaactgaggaaaatcaaaaagagaaagcaaataagctgtaagtctgcctttcttcatggtctacaacacagccttcctgtactcaacttatcaccagatcctcagctaacagaaaaacctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagcgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtttctaaaatcaaattactgggtgaaagaatagagctgttttaaagcacgtgtgccatatggccaaattattttcccaagggttcagatcaattgacacgatatcggcacttaccccctccagcattgggtaatgccatttttttctttctctgctaatttgaaagacaaaataacatttcctttaaaacacacattcggccgggcacggtggctcatgcctgtacccccaactactcgggaggctgaggtatgagaactgcttgaatctgggaggtggaggttgcagtgagccgagatcgtgccactgcactccagcctgggggacagagcgagactctgtctccagaaaaaaacaaaacaaaaaactcaccttctttccattattcttcaagtgaatacttgacagttgtgtgtcaactgtcaccagccaactgctttttattattttaaaagtaggtcacatacatggttgaaaacaatcaactggtaaaaaagatattggatagaaaggtaagtctgtgttctacttgagtctgag

SEQ ID NO: 291992 - DNA, 1915 bp, Homo sapiens
  misc_feature (1885)..(1885): n is a, c, g, or t
  misc_feature (1890)..(1890): n is a, c, g, or t
  misc_feature (1893)..(1893): n is a, c, g, or t
  misc_feature (1907)..(1907): n is a, c, g, or t
  misc_feature (1913)..(1914): n is a, c, g, or t
ttctagaggatcccggtatccccatacagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaattataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgagccctctcaccacagccaggagaggcctttcccaccggaagaagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactgggtgacagngtganacnccatctcaaaaaanaaaaanng

SEQ ID NO: 291993 - DNA, 4688 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatg

SEQ ID NO: 291994 - DNA, 541 bp, Homo sapiens
gagctcggtacccgacggcttcaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttccgttgaagccgtcgggatcctcagagtcaccgcgct

SEQ ID NO: 291995 - DNA, 4634 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggcttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatg

SEQ ID NO: 291996 - DNA, 4557 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttccgttgaagccgtcgggatcctcagagtcaccgcgct

SEQ ID NO: 291997 - DNA, 4760 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatgaaaaaaaaaaaatataaatctggccgccgattacacttgttaattggccttgcgttacccattttgctcttg

SEQ ID NO: 291998 - DNA, 1701 bp, Homo sapiens
ccacggagccttatgcattgtcttcccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatg

SEQ ID NO: 291999 - DNA, 4639 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctataaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatg

SEQ ID NO: 292000 - DNA, 4304 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtggattggtcccctcccggactgagtgtttacgtacgctaagataacaacaaagaaggtaaacgcactgaaataattcacaactcaatggacgggtaacagggc

SEQ ID NO: 292001 - DNA, 1589 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaaaataggagaaggggaacagaaaaaaaaacgggggggggcccgtaccaaattgcctaag

SEQ ID NO: 292002 - DNA, 585 bp, Homo sapiens
aaggttaagtgtatctggtgtatgtttccatagtatcctaggttccccatcacagcactcatcccactttattattgctatttatttattgttctgttttctttgctaggttagaccctccacgaaagcagggaccgtgtaaattcattcacccttatttcccccgtgctagtacagtgtctgctcatgataatgctgcttatttgttgaataaactaatgaatgctttatgatactagatggttgggaatctaaagattagtttagaatttcaattaaaatgtatgacttgcactaatgaaaaaaaagtcagtgctactgttctggtaactaattatttataaccccaaactattattttgtgtagggatatctctaagtttgctatgcattatataatagaagaaatagatgaagacacatcaatggaagacttgcagaaaatgatggttgtggcacttatatacagattattagtttgtttctatgaggtaagctactgacttcagcaagaattaatatttaacaatctaattttatgtttttacatttatttttttgagacagagtctcgctctgtcaccc

SEQ ID NO: 292003 - DNA, 4634 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttaaaatctgacagacaagtaacatgtcaattacttgatattccttgtctccagtaccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatg

SEQ ID NO: 292004 - DNA, 4637 bp, Homo sapiens
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcaccttccgattttacccaagtatatatataggatagaaaaaaatgcattatatttgagagctacttcgcccaaattacaaaatgagtgtttttagattcaagtgacagtaaaaggatttgttcccttcagtgacttgagtgttttagttatgcataagtatttctagcaaaggaagggtagaaaggaattgaaaattaatttacactagttgctacttgggaataaagggctttttgaggggggtatggatattaaatgttttcgttatatacttatccctattaaaacaggcagttgtttctttgaatatgcctaaataacagtattcttataccacaggccactcttgacatcccatgtttgcctggataaagttcctcatttcaaacagtatacatacttctttgcagttcattatagtaaggcttaacctgtaaacagtatctgatggcccacctataaataaaattcagcattctatttttaataatttgtatgccaccaatttgtattatttgtctcaataaatacttagtcatcaatg

SEQ ID NO: 292005 - DNA, 4122 bp, Homo sapiens
  misc_feature (4110)..(4110): n is a, c, g, or t
  misc_feature (4119)..(4119): n is a, c, g, or t
ggggaggggccattgggggagggaaacggagcagtaacaagtatcccagagggtgctgctgaggcgacgatggccgaggggcccgaggaagcccgaggccaccctcccgggcaggacgatggcggaggggaccacgagcccgtcccttccctgagaggccctcctaccaccgccgtcccatgcccccgcgacgacccccaggccgaaccccaggccccgggccggcccacagccccgggcctcgcggctgccgccgcagccgacaaattggagccgccgcgcgagctcaggaagcgcggggaggcggcctccggctccggtgcagagctgcaggagcaggcgggctgcgaggcgcccgaagccgcggcgccacgagagagaccagctcggctgagcgcccgcgagtactcccggcaagtgcacgagtggctgtggcagtcctactgcggctacctcacctggcacagcggcctggccgccttcccagcctactgcagcccccagccctccccgcaaagcttcccttcgggcggcgctgcagtcccccaggccgcggcgccgccgcccccgcagctgggctattacaaccccttctacttcctgagccccggggccgcggggcctgacccgcggacagctgccggcatcagcacccctgctccagtcgcgggcctgggaccccgggctcctcacgtgcaggcgtcggtccgggccactccagtgacgagggtaggatccgcagccccttcgcgaagcccgagcgagaccgggcgacaggcaggcagagaatatgttattccatccttggcccacagatttatggcagagatggtggatttctttattctcttctttataaaagcaaccattgtcttaagcattatgcacctcagtgggataaaggatatctctaagtttgctatgcattatataatagaagaaatagatgaagacacatcaatggaagacttgcagaaaatgatggttgtggcacttatatacagattattagtttgtttctatgagataatttgcatttggggagcaggtggagctaccccagggaagttcctgctggggcttcgagttgtgacatgtgatacatcagtgcttattgcaccaagtcgggttttagtgattccttcctcaaatgttagcattacaacgtccactatccgagctttgatcaagaatttttcaattgcttcttttttccctgctttcatcacactgctgttttttcagcataatcgaacagcttatgacattgtagcaggaaccattgtggtaaaaagaaatggggtcagatgatgccccccaaaaccctgatttccacacactaagactaaattatgtatcaaggccatcagtatccctgggttacactaattgatgatttagaaattaaagcagtcactccagtgtgatgcaggtgactactctgaaagtattgattatacttgaatgccaaagaacttgtccagaagaaaaacctgttaaattcaagtattaaaatttttagatcaaaaaggcaaatgattttataaacaatggacaatatatactttcttaagatctaaggtactttcttaagatctaagaatttgctgaaagcattttcagctttgaaatctccaaatgaaactttaaaatttattttggtttatcccaaaataatggaaaatgtccagttgtgttttgtaaacacctatgtaactcatcttttagtttacacttcctggggaaattgtctttggtgtttagaggagggaatgagaacacaaattggataatccactgtctcccatcccaggaggtggtgagttggctacaagagaaagggacaagtgaggcaggcctagcagttcccttacctgaagttttcaaatccatactgcagttccctctcgtaatgatgtaactttacaactattcttaatgcttgaacatgtatttaggggcaagtttctcatgatgatgaaaaagtatcaagtcatattgctatgttaattggtttttttttttaaaaggtaagttagtgattactgttaatggtgggggagtaagttttcactgtaaattgaacttataatttatgtgcaagtgttttcagtgccctgaatcaaactataaatgtggggagaaatcacctccatcaaacagttgcatatttactgtaaaagtattcccagtatgtgtgcagcatgaagaaagtattagtgcttctcagtgttctcagtgtaaattctatttatatacagcatattcacatactactttccttatattttatatagttctatgactgttgaaacatcaaggagttaaaaaaatcttaatatttcatgattaactctaagtacattaattaatagcttgcgaaatattagcaattttcccattatggactattctctctaaagcaagagagactagcattcccagacatcattctagggtctttaagctcattttgggtctgctaaagtttggggggaaatgttacgcaaagtgatactgtgtatgttgccattttgctttattcttctgttgaagcaaaattgtggggttttattatgtgtgtgtgcttttcctagatgtcccagttagctgtgctgagatatacctgtactatttatggtttaagttttgattcttaggtattttctccagctctgacattgttttccaaagacacactaaactgcattgcacagttcaaaatttgattacttaagggatcaatctaggtggtgttcttggtcttaaatttaacagcaaacacagcacatatctattatcactatattaattttcaaaggtttttctttgacgtttaaaactgtgacaacagatattcacatttgattatagaaacttaatgtctattaataattttagtacaaaatttcataaaccgtgtttttcaaaataagtttatgtcaaatccagcttcccagaaacactaataattaagtacatcaatgtactaaataaatcattcagttgcacccatggggaagattgtgttactgcccttcacagtgaaaaaaagaaaaatctttcatttttaaaattaggagatgttacgtaacttggcactttagtagtgtatacactagcattagtttatacaccacttttgccgctggggaattcaagttgaaatgtccctcaatcatataggtctggaatacatctttcattcataatttctgctcagataattgaatagtttgccatcgagattattttcatttatactataaaacaaaagcaaactagtccagtttaattttttgtacttagaatattgcacattttctatatatgagttattcagattagtatctatgtaggttcagtcagatccaaccatggattcgaggtattatactgtataaccctacaaaatacatagaagtattatttgccttcataatagaacccaagagtctgtttcaatttatgaattcagtatttgcaccgagattttgattcccaaagtttggaaaaaaatgacaaaacaacgagggaagaaggaaccagaccttagtgccacatatttttctcttggggttgtaaggtagtctcctgctttccagaacactttattatatttcacttatagacctgattttctgtgtcaaagtataattctcatgctgaagctgtagcctaaaaagccaaaagaaagttgtcttcattgtacaaacatattcatcactttaacaataagggaacaaaatttagtattcaagctgagtgagaatactgtttcaatgagcatgtccctaagataaaccagaattggcagttaatttaggcgtctagaaaatctcagttcccaccagtaaaattatcctgagtagctaatgcaccttgagaaaaatctggcatactgaataaataacattaacttgggagccaagagctgggtaagccttacctttagactactctgtgactacagaaataaagccagcacttttggaactaataagccttcacttgtcagtatcataaagagtattgcccaacggaactttgctcccactggtttaatagttacttatttctgcctaagcactcctactctgaaagtgggtncgagctggntgt

SEQ ID NO: 292006 - DNA, 489 bp, Homo sapiens
acccttcattcacctattaccattcaggacaaaacctctacttgtcctgctttgcggactctaacccaccggcacagtattcttggacaattaatgggaagtttcagctatcaggacaaaagctttctatcccccagattactacaaagcatagcgggctctatgcttgctctgttcgtaactcagccactggcaaggaaagctccaaatccgtgacagtcagagtctctgactggacattaccctgaattctactagttcctccaattccatcttctcccatggaacctcaaagagcaagacccactctgttccagaagccctataagtcagagttggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcc

SEQ ID NO: 292007 - DNA, 3253 bp, Homo sapiens
  misc_feature (3222)..(3222): n is a, c, g, or t
  misc_feature (3227)..(3228): n is a, c, g, or t
  misc_feature (3234)..(3235): n is a, c, g, or t
  misc_feature (3237)..(3237): n is a, c, g, or t
  misc_feature (3241)..(3241): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctgagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292008 - DNA, 6174 bp, Homo sapiens
  misc_feature (6143)..(6143): n is a, c, g, or t
  misc_feature (6148)..(6149): n is a, c, g, or t
  misc_feature (6155)..(6156): n is a, c, g, or t
  misc_feature (6158)..(6158): n is a, c, g, or t
  misc_feature (6162)..(6162): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292009 - DNA, 2061 bp, Homo sapiens
  misc_feature (2030)..(2030): n is a, c, g, or t
  misc_feature (2035)..(2036): n is a, c, g, or t
  misc_feature (2042)..(2043): n is a, c, g, or t
  misc_feature (2045)..(2045): n is a, c, g, or t
  misc_feature (2049)..(2049): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292010 - DNA, 6090 bp, Homo sapiens
  misc_feature (6059)..(6059): n is a, c, g, or t
  misc_feature (6064)..(6065): n is a, c, g, or t
  misc_feature (6071)..(6072): n is a, c, g, or t
  misc_feature (6074)..(6074): n is a, c, g, or t
  misc_feature (6078)..(6078): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292011 - DNA, 1351 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctgtgagtatcctttgttcctctgtgggccaggacaccagcttaactccaaacgaccagaggccaggcctctcagtctctctccggtccaag

SEQ ID NO: 292012 - DNA, 5895 bp, Homo sapiens
  misc_feature (5864)..(5864): n is a, c, g, or t
  misc_feature (5869)..(5870): n is a, c, g, or t
  misc_feature (5876)..(5877): n is a, c, g, or t
  misc_feature (5879)..(5879): n is a, c, g, or t
  misc_feature (5883)..(5883): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292013 - DNA, 1160 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaata

SEQ ID NO: 292014 - DNA, 1238 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaata

SEQ ID NO: 292015 - DNA, 940 bp, Homo sapiens
  misc_feature (537)..(537): n is a, c, g, or t
  misc_feature (549)..(549): n is a, c, g, or t
  misc_feature (551)..(551): n is a, c, g, or t
  misc_feature (557)..(557): n is a, c, g, or t
  misc_feature (561)..(561): n is a, c, g, or t
  misc_feature (565)..(565): n is a, c, g, or t
  misc_feature (568)..(568): n is a, c, g, or t
  misc_feature (594)..(594): n is a, c, g, or t
  misc_feature (598)..(598): n is a, c, g, or t
  misc_feature (612)..(612): n is a, c, g, or t
  misc_feature (619)..(619): n is a, c, g, or t
  misc_feature (630)..(630): n is a, c, g, or t
  misc_feature (637)..(637): n is a, c, g, or t
  misc_feature (644)..(645): n is a, c, g, or t
  misc_feature (649)..(649): n is a, c, g, or t
  misc_feature (651)..(651): n is a, c, g, or t
  misc_feature (668)..(668): n is a, c, g, or t
  misc_feature (672)..(673): n is a, c, g, or t
  misc_feature (689)..(689): n is a, c, g, or t
  misc_feature (691)..(692): n is a, c, g, or t
  misc_feature (714)..(715): n is a, c, g, or t
  misc_feature (720)..(720): n is a, c, g, or t
  misc_feature (723)..(723): n is a, c, g, or t
  misc_feature (740)..(740): n is a, c, g, or t
  misc_feature (748)..(748): n is a, c, g, or t
  misc_feature (755)..(755): n is a, c, g, or t
  misc_feature (757)..(757): n is a, c, g, or t
  misc_feature (822)..(822): n is a, c, g, or t
  misc_feature (827)..(827): n is a, c, g, or t
  misc_feature (831)..(831): n is a, c, g, or t
  misc_feature (840)..(841): n is a, c, g, or t
  misc_feature (850)..(850): n is a, c, g, or t
  misc_feature (856)..(857): n is a, c, g, or t
  misc_feature (901)..(901): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcancttcttacttgngnatgatnaaantcgnaangcggacacccgtctaaacaggaccangcgngggagggttccggnccccttngacaaacaatngtcggangaacggnncgcngnaacgtcgcagtcccccngttnntgtctttttcgttttntnntttccgttttctcttttgcgtnnggcgnttnctcgagtttctcgtggncctgaggnggctagngnttgctagccgttcccggggactttcttttgcattattagttttgttgtacctgttttgcaagttnctcgnggtncatgcctgnnggatatttntgttcnnttagctccggtgggacttcgtgcactttttgctgttaggccccngccgcttagggagtctgtcattttttagcgcccttctca

SEQ ID NO: 292016 - DNA, 639 bp, Homo sapiens
  misc_feature (466)..(466): n is a, c, g, or t
  misc_feature (470)..(470): n is a, c, g, or t
  misc_feature (480)..(480): n is a, c, g, or t
  misc_feature (488)..(488): n is a, c, g, or t
  misc_feature (494)..(494): n is a, c, g, or t
  misc_feature (608)..(608): n is a, c, g, or t
  misc_feature (613)..(614): n is a, c, g, or t
  misc_feature (620)..(621): n is a, c, g, or t
  misc_feature (623)..(623): n is a, c, g, or t
  misc_feature (627)..(627): n is a, c, g, or t
aggacttcttcctctccttaatccaacatagcagctgtgatgtcatttctgtatttcaggaagactggcaggagatttatggaaaggtctcttacaaggactcttgaatacaagctcctgataacttcaagatcataccactggactaagaactttcaaaattttaatgaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaanaaanaaaaaaaaanaaaaaaanaaaaanaaaaaaaaaaaaaaaaaaaaaaaaaaaaaaaaaaaaaaaaaaaaaaaaaaaaaaaaaaaaacaaaaaaaaacatgtgtgttggggcgccctgggcccctgaaaaagcttttctnagaanncattgnntngggncgcgggggcccc

SEQ ID NO: 292017 - DNA, 867 bp, Homo sapiens
gagcacagaaggaggaaggacagcacatcacctggaaggggctcctgcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaata

SEQ ID NO: 292018 - DNA, 178 bp, Homo sapiens
agaggtgggaccacggggtttatcgattacacaacaggaccctctatctatttggtgtcacaaagtatattgcaggaccctatgaatgtgaaatacggaacccagtgagtgccagccgcagtgacccagtcaccctgaatctcctcccgaagctgcccgtgtcaaacctctcggtccg

SEQ ID NO: 292019 - DNA, 1978 bp, Homo sapiens
  misc_feature (1947)..(1947): n is a, c, g, or t
  misc_feature (1952)..(1953): n is a, c, g, or t
  misc_feature (1959)..(1960): n is a, c, g, or t
  misc_feature (1962)..(1962): n is a, c, g, or t
  misc_feature (1966)..(1966): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292020 - DNA, 2052 bp, Homo sapiens
  misc_feature (1879)..(1879): n is a, c, g, or t
  misc_feature (1883)..(1883): n is a, c, g, or t
  misc_feature (1893)..(1893): n is a, c, g, or t
  misc_feature (1901)..(1901): n is a, c, g, or t
  misc_feature (1907)..(1907): n is a, c, g, or t
  misc_feature (2021)..(2021): n is a, c, g, or t
  misc_feature (2026)..(2027): n is a, c, g, or t
  misc_feature (2033)..(2034): n is a, c, g, or t
  misc_feature (2036)..(2036): n is a, c, g, or t
  misc_feature (2040)..(2040): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaanaaanaaaaaaaaanaaaaaaanaaaaanaaaaaaaaaaaaaaaaaaaaaaaaaaaaaaaaaaaaaaaaaaaaaaaaaaaaaaaaaaaaacaaaaaaaaacatgtgtgttggggcgccctgggcccctgaaaaagcttttctnagaanncattgnntngggncgcgggggcccc

SEQ ID NO: 292021 - DNA, 6453 bp, Homo sapiens
  misc_feature (6422)..(6422): n is a, c, g, or t
  misc_feature (6427)..(6428): n is a, c, g, or t
  misc_feature (6434)..(6435): n is a, c, g, or t
  misc_feature (6437)..(6437): n is a, c, g, or t
  misc_feature (6441)..(6441): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292022 - DNA, 6536 bp, Homo sapiens
  misc_feature (6505)..(6505): n is a, c, g, or t
  misc_feature (6510)..(6511): n is a, c, g, or t
  misc_feature (6517)..(6518): n is a, c, g, or t
  misc_feature (6520)..(6520): n is a, c, g, or t
  misc_feature (6524)..(6524): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgggagatgccaactctgaatgaaggatgcctgtggaggaatcaaaggtgccacacaggacaatcttctgttatccacacagcgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292023 - DNA, 6531 bp, Homo sapiens
  misc_feature (6500)..(6500): n is a, c, g, or t
  misc_feature (6505)..(6506): n is a, c, g, or t
  misc_feature (6512)..(6513): n is a, c, g, or t
  misc_feature (6515)..(6515): n is a, c, g, or t
  misc_feature (6519)..(6519): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactatgtgggacaactacaaaggctgtcacatacacttaacgggaatacttgtggtttggggaccagatggaggtggccagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtaagtggatcccagcatccttggcaatagggttttaggtggagtctatctggctttcagagaagagtcaggaaaacatttgtattcccagactgtgtcccatgggcacaagcaaatcccaaattctcctcctgaaccctcccaacttatctctacagactctcttctgcttgtttttctgttttctcatggctgaccttgtgtctggcctgagaaaggtagggagggggctttatcagccctgagccctatgtggtagaagaggcttcacagagggacaagaaggagagtcctcaagatcaagttgcttctcgctgtcacgaacacatccccttctgccatgtctttgttttcttgtacctattccatgagctacaaggaacatctgaggctttgaaacaagctcacacttttcccccaaatgagaggaggaagccctttgggtgagggaggagcagctcagactctgcttcctgctctgctccgggctcctctggtgactggcctggccctgcctgactccacctggggtggaaccaacatgtgtggagaaagggccctggtggcctgtcctgaagttggctaaatcgagctgccagttgaagccaagcctcccccgggccaggctgcagggaaataagaagagagggagcttcagggctgactcctgagctgcatcctggctctgaagtcaccagctgtatgaggctttgggcacagcacgtgggacacagcacggaggacagtgactgatgcagagctagagaaatagggagattcacccctggggctctgcatggcaggaaaggggcagtgccaaaaagtgtgtaattatagagagggcaagaccacgagacactttatatatatctaatattagacttaccattaactaagtgtgcaatttagtgttgtgtaactatcacactatccatttccagaactttttcctcttaccatattaaacctctgtacccaataaacagtaactctcactccttctccccctaacccttaacacccaccattctactttctgtctctatgtaactggctattctaactatcttttataaatggaattatataataattatccttttgtgtctggcttatttcagttggcataatatcttcaaggttcatccattttgcacgatgtattgtaattttcttccttgttaaggttgaataacatttcaatgtatagatacatctcatttgcctacccacttatctttcaatggacttttcagttgtttccatttttggctagtgtgagtaatgcttctctgtacatcagtgtacaaatatttcttcaaatttctttcaattctatagggagtatgtccagaaggggaattgctggatcaaatggtaatttattgtttaattttttgaaaaacagccacactactttttacattggctataacatttcccattcccatcagcaatgcactagagctccaatttttccatctacttggaaacacctgttgtttagtgttgctgtcattgttgttgtttatcaaagccatcctaaagtgtgtgaggtgttgtaacattgtggttttgatttgcatatctctaagtattcgtgatgctgaggaactttgcatgggctatataaaaggttttgatttttatgaagtctgatttatccattttatttgttgcctatgcttttgttgttacaaccaagaaatcattgtgaaatccactatcatgaagtttttcttctaagagttgtatagtttttactcttacatttagatctttgatctattgtgggttaatttttgtacatggtgttaggtaaaggttccactcttcttgcccttggatatccacctttcccaatatcatttggtgagaacactgtcccttccccattgaacgatcttggcacactcgatgaaaatcatttggccatatatgcaagcatttctttctgggctatgatatttcattaatttctatgtcctcctttatgccagtaccacactgtattgattactggggctttgtagtaaatgctgaaatcaggaagtgtgagtcctccagcttcattcttcctcttcaaagctgtgtgtctatttagagtcatgagatgcaatataaattttaggacagatttttctttttctgcaaaaatgtcactgagattctgataggaattgtattgaatctgcagctcactttgggcagcactgtcctcctaacaatattgagtcttccaattcatgaacacaaaatgtctttcaatttattgatgtcatctttcatttctttcagcaatactttgtagatttcaggtataatcatttcacctctttggttaaacttattcctaaatattttattctttttgatgtgaatataaattgaaattatttttcttaatttcccttcagattgttcatggttagtgtattgaaatacaactgatgtttgaatgttgattttgtattgtgcaacattactgaatttattaattctaataggtttgttccatctttaggattttctacaaataagttcaagttatctataaacagaaataattttactccttccttccaatttgaatgtctttttaaaaattcttccctaatttttctgattagacctttcactactatgttgaataaaagtgtcaatagcaggcatccttgtcttttcctgctcatacagggaaagttttcagtctttctctgttatgtaagatgttagcattgggtttttcacatattgcctttatgttgaggtggttgccttccattcttagaatgtttttattatgaaaaaatactgaatttcatcaaatgcttttattgattcaatcttcttactgattatagttatattcatatttttgtgtgtttctaggagtttgtctatttcatctaggttatccaatttattggcatacaattatttatagtactttcataatcattattttattagaattggtagtaatcgcttcatttttcttttttctttttcttttaagacagagagacaggctctcactctgtaggccaccctaggatggaatacagtggtgtgattatggctcactgcagcctcaacctcctgggctcaagcaattctccttcttcagcctcccaagatgctaggactacaggtgcatgtcaacatgcccagctaattggttttttttttttttgtagagacagcatctccccaggttacctatgctggtccaaacacctggtttcaagaaatccttctgctgtgacctcccaaagtgctaggattaaaacatgacccaccatgctcagagtccattttcatttatgatttgagtaattttatcttttctctttttttcttagccaatctagttaatggttgtcaattttgttgattttattttgaagaatcaacttttggtttcagtaatttcctctattctgtttccattctccattttatttatatccaccctaatacttattatttccctcattcactgtgcttgggtttagtttgttcttctttcgtatcctgaagtattaaagtaggttgttgacctgagctctttcttcttttttaatgtaagagtttacagttataaatttcttgcacaagactcaacttctctgaacccctgattcctcacctgaaaattgcaataagagtactttcttcataccattcttttaaaggtttaatgcagtcaatgaaacaagatgccacacaaagaggaaccaatgtcagctgctatattactaccatcatcattagccttgaggtcaaatagtcctagaatcaaatctcagatccacctgtcactagccatatgacaccaggaaagtttttacaccatgctaagcttctgtcttttcatcagcaaaatggaaataatgcctacctgacagggttattgtgtggattaaatgagatacaggtaaagtattgagcacagggcctggcacatagaaagtgcacctcaacagtacctacctttttccatagatatgaaaaaagcggtaacacataaaacactaggacatggttactgactaattgtgggagagaaagaaaaaaagctaagtgcaaagaatcaagtctggtatgttagtttttaccaactgagatgcatccaagatgggattagacatacaagataatttatcagggaagacacctgtgagggaatgtggggcaggcatgaaggtagtatgggagaacccacagaccgctatgcagagctgattcctgtgaaaaagaaagagaaagaagttttaggtaccaatgcagttctaagagtttttgcaaggctgatgaggaatcctccaaccagtcacccattggagttaaagagagcctcggagaactagacttgctttcacacccttgctgggagcctgtgggaaagaagctttctctgtaaaggaggtagtgaatttgaaatgcgctgacctgggccttctgtcaatcaggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292024 - DNA, 1505 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctcccgaagctgcccatgccttacatcaccatcaacaacttaaaccccagggagaagaaggatgtgttagccttcacctgtgaacctaagagtcggaactacacctacatttggtggctaaatggtcagagcctcccggtcagtccgagggtaaagcgacccattgaaaacaggatactcattctacccagtgtcacgagaaatgaaacaggaccctatcaatgtgaaatacgggaccgatatggtggcatccgcagtaacccagtcaccctgaatgtcctctatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggctaggacactggcgaggctaga

SEQ ID NO: 292025 - DNA, 1699 bp, Homo sapiens
  misc_feature (1668)..(1668): n is a, c, g, or t
  misc_feature (1673)..(1674): n is a, c, g, or t
  misc_feature (1680)..(1681): n is a, c, g, or t
  misc_feature (1683)..(1683): n is a, c, g, or t
  misc_feature (1687)..(1687): n is a, c, g, or t
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagacctccccagaatttacccttcattcacctattaccgttcaggagaaaacctcgacttgtcctgctttgcggactctaacccaccggcagagtattcttggacaattaatgggaagtttcagctatcaggacaaaagctctttatcccccaaattactacaaatcatagcgggctctatgcttgctctgttcgtaactcagccactggcaaggaaatctccaaatccatgatagtcaaagtctctggtccctgccatggaaaccagacagagtctcattaatggctgccacaatagagacactgagaaaaagaacaggttgataccttcatgaaattcaagacaaagaagaaaaaaactcaatgttattggactaaataatcaaaaggataatgttttcataattttttattggaaaatgtgctgattcttggaatgttttattctccagatttatgaactttttttcttcagcaattggtaaagtatacttttgtaaacaaaaattgaaacatttgcttttgctctctatctgagtgccccagaattgggaaactattcatgagtattcataggtttatggtaataaagttatttgcacaagttcaaaaaaaaaaaaaaaaaacaaaaaaaaacatgtgtgttggggcgccctgggcccctgaaaaagcttttctnagaanncattgnntngggncgcgggggcccc

SEQ ID NO: 292026 - DNA, 1037 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccatggtccagaactccccagaattacccttctgtcgtctttaagcgatgtctagat

SEQ ID NO: 292027 - DNA, 1079 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcatcacttttaaacttctggaacctgcccaccactgcccaagtaataattgaagccaagccacccaaagtttccgaggggaaggatgttcttctacttgtccacaatttgccccagaatcttactggctacatctggtacaaagggcaaatgacggacctctaccattacattacatcatatgtagtacacggtcaaattatatatgggcctgcctacagtggacgagaaacagtatattccaatgcatccctgctgatccagaatgtcacacaggaggatgcaggatcctacaccttacacatcataaagcgaggcgatgggactggaggagtaactggatatttcactgtcaccttatactcggagactcccaagccctccatctccagcagcaacttaaaccccagggaggtcatggaggctgtgcgcttaatctgtgatcctgagactccggatgcaagctacctgtggttgctgaatggtcagaaacagccacagagaaccagagaagtgcctgtggatcatacgtgatggccatgtccccacacagatctccaacagccagttagtgtcgcccactgaaaaacattccatccatgagaatacgcccatgaaactggaaatccagcatctctaaggagaccgtactactgctaatatcagagacattttgtgagtagttgctgtcacaactgatggaagttccttcactacatctacagatccggcacagtatg

SEQ ID NO: 292028 - DNA, 797 bp, Homo sapiens
tgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagaaagaaagagaaagaaggaggaaggacagcacacctgacagccctgctcaggaagtctctggatcctaggctcatctccacaggggagaacacacagacagcagagaccatgggacccctctcagcccctccctgcactcagcacatcacctggaaggggctcctgctcacagcggagactcccaagccctccatctccagcagcaacttaaaccccagggaggtcatggaggctgtgcgcttaatctgtgatcctgagactccggatgcaagctacctgtggttgctgaatggtcagaacctccctatgactcacaggttgcagctgtccaaaaccaacaggaccctctatctatttggtgtcacaaagtatattgcaggaccctatgaatgtgaaatacggaacccagtgagtgccagccgcagtgacccagtcaccctgaatctcctccgtgagtatcttctgttcctctgtgagccaggctgccatcccaaatacaagtggccagaggccaggcctctcagtccctctcaggtccaagtacagagacctttatccctgaacatcaaagctggccatgactttctgctccaggcaaaccagagtaggcctaggcttgatcaacaata

SEQ ID NO: 292029 - DNA, 815 bp, Homo sapiens
cccagttaattgctacccagtcagtgttttgcccaacaatctcgacttaagttgcagtgctctcttattaacccccgctacagatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtc

SEQ ID NO: 292030 - DNA, 738 bp, Homo sapiens
ggccaggctggttttgatctcctgacctcaagcgatccactgtcctcggcctcccaaagtgttgagattacaggtgtgagccaccatgctcgctgagagcagatatttgaaatgtcactttgagttctgagaaaaagtaaaaagccagaagacatactagatatataaatatattactgcttaaaaagatttcctaaaaagaaatgtatcaagtgtatgaatcaaagtctgaaagaaagatgaagagccaccagacttctaggtaggtttacatccatcatgttcctcttgactgcctttgtttgtcgtttagttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtc

SEQ ID NO: 292031 - DNA, 882 bp, Homo sapiens
  misc_feature (4)..(4): n is a, c, g, or t
  misc_feature (13)..(13): n is a, c, g, or t
gcgnccgccggtncctaccctgccctccgtcccgacgcgcactatcagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttgtatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataatt

SEQ ID NO: 292032 - DNA, 549 bp, Homo sapiens
tgttaattctaaggataaaaaagcctgctagtagcattaaaatctcttggtgtcctaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacgtgtgtggcagtaagatatccaatctcaatagatttgaacaaaagttc

SEQ ID NO: 292033 - DNA, 2828 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatccccgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292034 - DNA, 2985 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292035 - DNA, 2777 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatccccggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292036 - DNA, 2663 bp, Homo sapiens
taacgagcgtacacttaggctaggtacgaggctggtttaattcggccgagggcgctccggagtccatggccggcacgcgctgggtactcggggcgctgctccggggctgcggctgtaactgcagcagctgccggcgcaccggcgccgcctgcctgcccttctactccgccgctggctctatccccggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292037 - DNA, 3021 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagattaaaaaaaaaataaaagggcggccgctcgcgatctaga

SEQ ID NO: 292038 - DNA, 2743 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtg

SEQ ID NO: 292039 - DNA, 2910 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292040 - DNA, 3228 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgaatctctggtcggttgggcagtgagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292041 - DNA, 3279 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgaatctctggtcggttgggcagtgtaagtgtggctggggtgaatgttgaggccttgttccccgcctggcccatggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292042 - DNA, 2561 bp, Homo sapiens
ggcttgtagggaaggagcctgtccccatcgcgccgttccctctcctgtccccagggaaagacgagctgtcccggtttactgaaggtcacctctgcaactccactcatacagaaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292043 - DNA, 2499 bp, Homo sapiens
  misc_feature (4)..(4): n is a, c, g, or t
  misc_feature (13)..(13): n is a, c, g, or t
gcgnccgccggtncctaccctgccctccgtcccgacgcgcactatcagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292044 - DNA, 2720 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtg

SEQ ID NO: 292045 - DNA, 1863 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtc

SEQ ID NO: 292046 - DNA, 2631 bp, Homo sapiens
atggcgacatttcaagcagtttaagattgccaagacaaaatagtgatggtggtcagaaaaataagcctcgtgaacatattatagactgtggagatatagtctggagtcttgcttttgggtcatcagttccagaaaaacagagtcgctgtgtaaatatagaatggcatcgcttcagatttggacaagatcatccttgttgatttccaggtaagccccttgaaatggtcgccaatccggcgaccatttcaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292047 - DNA, 2411 bp, Homo sapiens
gtgggttgactgtgggttgaccgtggctgtgggttgaccgtggcttgtgggttgactgtgggttgaccgtggctgtgggttgaccgtggcttgtgggttgaccgtggcttgtgggttgacccgtagcttgtgggttgaccgtggaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292048 - DNA, 1922 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcata

SEQ ID NO: 292049 - DNA, 2631 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292050 - DNA, 1944 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtcaaaaaaaaaacaaccaccctcgccacccgcacagtcaacggcctaacagaccgacacgcacaacacaaccggcggacaggcacacacagagacaggcgggcaacctacggagatctcgacaccatcaaccggacagctgtgactcaagacaccggc

SEQ ID NO: 292051 - DNA, 1942 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggactgaatatagttgacattacttttgtgatggactatagagggaggcgaaaaacaggggaagcctatgtgcaatttgaagaaccagaaatggccaaccaagccctgttgaaacacagggaagaaattggtaatcgatacatcgagatatttccaagcagaaggaatgaagttcgaacacatgtcggttcttataagggaaagaaaatcgcatcttttcctactgctaagtatataactgagccagaaatggtctttgaagaacatgaagtaaatgaggatattcaacccatgacagcttttgaaagtgagaaggaaatagaattgcctaaggaggtgccagaaaagcttccagaggctgctgattttggaactacgtcttctctgcattttgtccacatgagaggattacctttccaagccaatgcccaagacattataaacttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataaggagcagaagcatttcattgccattcttcttggcctggatatcagtccagtttattagcagcatgtacggcacagcattggggtggggtaatgttctagaaacgtcatgtggctgttacagacaaatgcagccccggtggctttcaactacccaattctaattgggtacggcggctgttaaatgggtgctgttagtacagtggtccgaggatgtcctgtagaaccattttcgggggtaacgccctaaaacgtgggggaggcggaacaggcggggtccacacaacacagcagggg

SEQ ID NO: 292052 - DNA, 1860 bp, Homo sapiens
ggccaggctggttttgatctcctgacctcaagcgatccactgtcctcggcctcccaaagtgttgagattacaggtgtgagccaccatgctcgctgagagcagatatttgaaatgtcactttgagttctgagaaaaagtaaaaagccagaagacatactagatatataaatatattactgcttaaaaagatttcctaaaaagaaatgtatcaagtgtatgaatcaaagtctgaaagaaagatgaagagccaccagacttctaggtaggtttacatccatcatgttcctcttgactgcctttgtttgtcgtttagttttttgctccactcaagcctgttagaatcaccatggaatacagctccagtgggaaggccactggagaagctgatgtgcactttgagacccatgaggatgctgttgcagcgatgctcaaggatcggtcccacgttcatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292053 - DNA, 1984 bp, Homo sapiens
ttagtagacacaggtttcgccatgttggccaggctggtctcgaactcctgggttcaaatggtccacctgcctcgacctcccaaagtgccgggattacaggcatgagccaccgcatccagcctgtttgtccattttacattttgtttgtttgtggttgtttgagacggagtcttgtctgttgcccagtctgtagtgcagtggtatgatctcagctcactgcaacctccgcctcctgggttcaagtgattgtcctgccacagcctcccgagtagctgggactataggcacccgccaccacactggctaatttttgtatttttagtagagatggggtttcgctacattggccaggctggcttgaactccttacctcaggtgatcctcccacttcggcttcccaaagtactgggattacaataggcgtgagccaccgtgtccggcctaaattttgtttttaattagggaaaggaaagggcaaagggtttgagttgctgtctgaactgtgagaaaaatggctgtaatatttttctaccttttcaactttttaaaactaatctttctcattatcctcagatcataggtatattgaactgttcctgaattcatgtccaaaaggaaaataagactctaggggctccagataataagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292054 - DNA, 2274 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgaatctctggtcggttgggcagtgagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagggtgaagcaagaagcatttcatttgcacatctttcttggacttgggatatacagttccagtttattagcagcaactgctagggaaatgattttggtgttttgggttaattgcttctaagaaaagtttcatagtggactgtttagaagaagaaatgaaagatccagtttgggattatgaaataaaccacaaattaaaatttttgtttaaactgtccaggatctgatttaaaaatatggtctttgttttatatgattaaatggtttgttttcatagatgatatgttactcattgtaaagaccacatatttttattcagcagtgttctttaaacgctttcatttaaaaagtaactttttttttttgcctgtgaattgagtgctctgatgtaaaacttctcatggagtgaaacagtgatttattttaaccaaacattcaccaaagcaaagaacggtttcagacctttgaactggtatggtttggcagaatagttttaaattttgctgtatttgattacttagagataggaatttttaaaaatcaaaacaaaaaataccacagcttagtgtaaatgacaatttggcggttttatgtctttagaaatgttttgcctttctaagccttgtgctaaaggcgtataacggtggtgcctatctacttaagggggcattctagtcttaacttaaaagttgtctaaactgtccctccctggctttttttggtttggggtagacctaagggtgtttgttagtctcaaaactgtgaagtgacatgtcagaacagtccagactggtaagaaaattaatggcttcacttgaatttaaaccagctctagataggaaaaaaatcagtctcctcatttgctttttaaatggagtagtacatcccatattttagaacaagtaggggtgccttgcttaaataaaaatagcatttaatgtataattgtgtgaagggtttatggataaagctgtacttctgtcacaatgtggcagtactttctgctttaatattaaacagcttgttatttaaatattggacaaaatggctggcttcaaaatatagtcattaataaactaactttatgtgcacctgtgtaggagaatcaaaatcctgtatgctttctttgccttgttcctgttctcagggtgacgactgccaccaggagatgcagttctagttcttaaaattaaatttgcccaggtttctgacaggtgatacctggaagagagactatgtcttctcttacttaatacataaccatctttgattaccagctaagatgcgaaatcactgtactgtagtcaataaatgaagacttgtttcaggctgaagatta

SEQ ID NO: 292055 - DNA, 1087 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagagaacggatgtgtcatgtgggcacagggatagtgtgaagatgatatgagagtatacaccatgtgcaagtatggtgagtatgccgataacacgaaagagcattgacaggatacaaaatcattcgcctggtgagataagatgaatggtgtgagatcacagaaagagagaaggaacctatcgcattaattagataagcacaagtggaagcaaccgggacaaataggataagaaacttgtcactagtcggcaagcgacacgtggaaagtacttaggtgaggaccgattgcaccttgaaggaggagtgggaccgtaattcggcaaggacgaagggcagaaaacacaacaaggcgagaacagcctaatggttgcaacgatttggacagaaaa

SEQ ID NO: 292056 - DNA, 451 bp, Homo sapiens
gagagactatgtcttctcttacttaatacataaccatctttgattaccagctaagatgcgaaatcactgtactgtagtcaataaatgaagacttgtttcaggctgaagattacctaagagtatttattattggagtctgtgagtcaactgaatatattattacctcaagtcctgctatattaatataagtagtaagggttaattttcgtgtgtgtgttctctaaaatcctgtgaacatgacttaaccagcttaacatcatcagtagtactgcctagatggaaatgcgttttcatatatggttgaatatgccaagctatgagaactggtatctgtagttgtacgaactattagaatgtgatctttgttgctctttcacatttggtatctgatttgctgtggaaaagatctgtggggcctactgtgaggaattcatctgcaattgatttaagc

SEQ ID NO: 292057 - DNA, 1368 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggagtccaaaactacttacctggaagaccttccaccaccccctgagtatgaattggccccgtccaagttagaagaggaagtggatgatgtctttctcattcgagctcaaggactgccctggtcatgcactatggaagatgtgcttaactttttttcagactgcagaatccgcaacggtgagaatggaatacattttctcctaaacagagatgggaaacgaaggggtgatgccttaattgaaatggagtcagagcaggatgtgcagaaagccttagagaagcaccgcatgtacatgggccagcggtatgtggaagtatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttgtatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataatt

SEQ ID NO: 292058 - DNA, 1393 bp, Homo sapiens
agactgggcggagcgtcgcgctctcctccacctccttccgactctcggaggccccccacccagtgcccgcggcgcatgtgccaggcacaccccacccccaaccggccctggattccacttccgttccaccatcgctgctggagcagctgccttcaggccctgcgccgcctccggagtccatggccggcacgcgctgggtactcggggcgctgctccggggctgcggctgtaactgcagcagctgccggcgcaccggcgccgcctgcctgcccttctactccgccgctggctctatcccccgtcgggcgtctcgggccgccgccgcctgctgctgctgctcggggccgccgcggccgctgcctcccagacgcgtggcctccagaccgggcctgtgcctcccgggaggctggcggggcctcccgctgtggccacctctgccgcggccgcggccgccgcgtcctaccctgccctccgtgcctctctgctgccgcagtcgctggcggcggcggccgccgtcccgacgcgcagctacagccaggtacgtgggcgccgtgagggacctggcgcgagatccctcccgggccgcgtgcacgcgcccccgcgcccctccgtccctccgtgtgcgcctcgcgggcacgcccggggatccgcgacactcgccgcacacccgcccccgtccaccctgtgctcctattgggccctggaacaagggaagctctcccaggcgtcgggtcttctgcttgttttgttctcgcctcgaatctctggtcggttgggcagtgtaagtgtggctggggtgaatgttgaggccttgttccccgcctggcccatggagtccaaaactacttacctggaagaccttccaccaccccctgatatatgagataaacaatgaagatgtggatgccttaatgaagagcttgcaggtcaaatcttcgcctgtggtaaatgatggtgtggttcgtttgagaggacttccttatagttgcaatgagaaagacattgtagacttctttgcaggtactttgcagttgtattatgcttgggagctcatatcttttttcccttggtatctccttctatatcttagatgagcctgtttctgggcaaaggcatgcagttatattaggttctttaggggagagctcttcacttaaatttctaatatttatagattttgtatgtgtttttgttctatcaggcagattttaggagggaagtcagatttcagaataatttcatgagggttttactattgaaggaaataacttctcataatagttgctgtatttgtgtaagacaataacaatttatataatttaaaagtattttctaattcctagaaccattagcagtgaagtctgtgatttctattgtttcctagtatataatt

SEQ ID NO: 292059 - DNA, 323 bp, Homo sapiens
gcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttca

SEQ ID NO: 292060 - DNA, 1703 bp, Homo sapiens
gcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292061 - DNA, 1649 bp, Homo sapiens
gcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttctttttctttttcttcttttttttttttgaga

SEQ ID NO: 292062 - DNA, 1807 bp, Homo sapiens
gcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccgagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcgcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292063 - DNA, 1925 bp, Homo sapiens
ttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292064 - DNA, 1837 bp, Homo sapiens
ttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292065 - DNA, 2302 bp, Homo sapiens
ttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggtaggtttgtcttcttcccccttcccaagggcatggctgggcttatggagagcctgttccttctccccatcccctaaaaggaagagaagatggaagccagccttccccccaaccagacccaggccctccagcatggactgagcctcctccctcaaaccttctcccttagacctggcccaggtgggtgttggtggggttctggctctccctgtgcctacaggccaagggctgggcctagccttctacttcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292066 - DNA, 1609 bp, Homo sapiens
tccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaaggcggggccgagcaatgcaggaggcaagagaaagctgtccctgatgctggatgaggggagctcatgcccaacacctgccaagttcaacacctgccctctacctggtgcccttctgcaggacccctacttcatccagtcggtaggtttgtcttcttcccccttcccaagggcatggctgggcttatggagagcctgttccttctccccatcccctaaaaggaagagaagatggaagccagccttccccccaaccagacccaggccctccagcatggactgagcctcctccctcaaaccttctcccttagacctggcccaggtgggtgttggtggggttctggctctccctgtgcctacaggccaagggctgggcctagccttctacttcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292067 - DNA, 1639 bp, Homo sapiens
tccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggtaggtttgtcttcttcccccttcccaagggcatggctgggcttatggagagcctgttccttctccccatcccctaaaaggaagagaagatggaagccagccttccccccaaccagacccaggccctccagcatggactgagcctcctccctcaaaccttctcccttagacctggcccaggtgggtgttggtggggttctggctctccctgtgcctacaggccaagggctgggcctagccttctacttcctctcccagagacaaatttgggccttagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292068 - DNA, 1387 bp, Homo sapiens
tccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292069 - DNA, 1980 bp, Homo sapiens
ttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292070 - DNA, 1462 bp, Homo sapiens
tccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagccctcacagggccaggggccccatcatctctgacatcccagaagactctccatcccctgaggggaccaggctttctccctccagtgatggcaggagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacagggggcctctgggcctggaaagcggggacaggagcccagagagtctgctgcctccgatgctgcttcagccccctcaagaaagtgtggaacctgcagggcctctagatgtgctgggccccagtctccaagggcgagaatggaccctgatggacttggacatggagctgtccttgatgcagcccttggttccagagcggggtgagcctgagctggcggtcaaggggttaaattctccaagcccagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292071 - DNA, 599 bp, Homo sapiens
tgagttcaggctgcactgcagagcgttccttgagccacccatgccctcaccattgggcgagagtggggaggttaagaatggatgttttatcctaactgagcagaaggcaggcgggcagggctctccttccctgaagaaaggagggggaacatttcccctggtgagcgcagtcccacttctcctagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292072 - DNA, 1465 bp, Homo sapiens
ttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggcagaacgagatcttgtggcgggaggtggtgacacttcggcagagccacggtcagcagcaccgggtcattggcaagctgatccagtgtctctttgggccacttcaggcggggccgagcaatgcaggaggcaagagaaagctgtccctgatgctggatgaggggagctcatgcccaacacctgccaagttcaacacctgccctctacctggtgcccttctgcaggacccctacttcatccagtcggaagagaagatggaagccagccttccccccaaccagacccaggccctccagcatggactgagcctcctccctcaaaccttctcccttagacctggcccagcctctcccagagacaaatttgggccttagccctcacagggccaggggccccatcatctctgacatcccagaagactctccatcccctgaggggaccaggctttctccctccagtgatggcaggagcccccccgccactgcctgtggctgtggtgcaggccatcctggaagggaaagggagcttcagccccctatcgggggtgagcgaagcccccactactaaatggcctctctccactaccccgactatccctgcacataaactccgttttttttttttttttttttttttttttttttttttttttttttttttttttttttttttttttattcctttaaaacaggttgatggggggggagttgaacaatggggcatt

SEQ ID NO: 292073 - DNA, 885 bp, Homo sapiens
ttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgcccgcgctgcgcggcgacgacggccgctggcgcccggaggacctgggtcgactactgggcgaggtgcaggctttgcggggagtgcaggagagcaccgaggcgcggctgcgggagctcaggcagtgcgggggcgggcggggaaagaggggacaggggtggggggttcgggatgagaccataactggccggccagcagttctgggcag

SEQ ID NO: 292074 - DNA, 211 bp, Homo sapiens
ccctgttaagccttcctccctcacctggaagtgcgggggtgggggggctgtgtccaaagtatgaattaaacctttgctttctcttcagctgatccagtgtctctttgggccacttcaggcggggccgagcaatgcaggaggcaagagaaagctgtgagtgagaaagccaagaaggcccacacccacttccaagaccccccagaagtcccct

SEQ ID NO: 292075 - DNA, 1233 bp, Homo sapiens
  misc_feature (631)..(631): n is a, c, g, or t
  misc_feature (1058)..(1058): n is a, c, g, or t
gtgcaagatttaataaaaaacaaacaaaaataggaatggttgctttcaacattttccaggttgtgaaaggttttgactgatttggggaaagaatggtgaaaaagagcttctcagttctcctgaggtgctcgctgacaaccacacctgtgtgtctgggtggggccgagtccgtcacacagaggtgacatgtgagctgctgtttccattcagagctacaggagtaacgggctgggaaaaacaggtgtcctgctagacagtggctgtgaggatgtgtaggcaggagcagtggcagccacctgggagtcaggagcttgcagcacaatggtgctggctgtgtgcgcgcctggctctgccacatgagcgtggaaggcaccacctgaacatggcttttgaggggcctagtcatcctagtcatttactggggcagcttcctgagtggaaggaacataagggcacaggtatcatggtaaacttttgagtctaagggatgatgcttgacagccacacatggtgggtgtggcctgcagctacaaagggtggggccagacagctgggcctccactcagcccaccaccacctccagggcctggcatttcgcctttgtgctccaggacctcaggggcggggatgnaggacagttctggggaaaatctacttgtaaaggtcctggggaaggggacaggagtggctggaggctgtgctccgtgggaaagttcttctcaccagagcacacatcaaatgccagttccagagagggaccctccgcccgactgtgctctcctagggcaatcaggaggagactgccctccaactgggccctggctctccggggtgttgctgtgagtacaaggctgtcctcaggcagctgcctcagatttgggctgggactgggccagacggggttcccggggcaggggcaggaaggaggcaaggctggcaaggggattgggggctgctctcaggaacacggagaggccgcattaggcaggcagggaagtgctgggaagactacgtgctcctctcccaccagggaccctggcggccctcctgctagttcncctcctggtggaggacactgggggatgccgaacaagaggctaagcctgcggcccaggccctgctgagaccacaccatggctagcaagtagagggacagcagcatatcccctcaattctgcctgcacggtagctgagccagacgtccccacacccaccccattatcaaggaagatc

SEQ ID NO: 292076 - DNA, 920 bp, Homo sapiens
agggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagt

SEQ ID NO: 292077 - DNA, 1099 bp, Homo sapiens
agggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtaaaaaaaaaaatcaccacacacaaaaacccgggcgacccatatcggggtcgggcaaaaacgggtctacacattgcgctgcgccaacaacgtgtccctggaccagctttctggaccacggggcaacactggcgggaccccataaggagcgctaattgaaaccgtaccgatacatcaaacg

SEQ ID NO: 292078 - DNA, 571 bp, Homo sapiens
agggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagt

SEQ ID NO: 292079 - DNA, 1654 bp, Homo sapiens
agggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtaaaacaaaaaaaaaaaaaaaaacctgggggctctcacactgccgagaggcggggcaaaaagaggacaagaaacgggccaagggcccaacaccgcggcacccggagccccacagaaacggtcgaacaacgggagcacaaccgcagcgggacacccaaacacaggaaccacacaacacacccacaaaacacacggcaacacgtcgcgctcaagggacccggcacaacaacaccacaaacgcagcaccacacacacagacggagcgacaaccaacacacgcacgcaacgcaggacaacggacccagccaaccccacgaaacaccaccacacacgccaaagaacaacgaaacggagagggaagaacagaaagggaaacgacgagccgacgacgggagaaggggcacacgggaagccggctcaagaagcgggcccgagcggaaagcagcgggagagagggtgaccaaaagagcaagcagggagagacacaacgacgcgagcgggcagcaagggcgagaagaggaacgcgagaacaggaccgcaaggaggaacgcacagaaagccgaaaaaacaagaagaaccggagaggccggagaacagaggagcgggcacgcaggagcagggcgggaacgaggccgaggcagagaaaaagggacgcgagaagagggaagaacaaacaccccaagaaacgagggaacgagggagaaggaagagaggaaggaaacccaacagcccagcg

SEQ ID NO: 292080 - DNA, 889 bp, Homo sapiens
agggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagt

SEQ ID NO: 292081 - DNA, 859 bp, Homo sapiens
agggaaggggcggggcgaacggaagccgggaaggcgattcatagctcgcggggtacgggcgcgcgtgcgcactccgcagcccgttcaggaccccggcgcgggcagggcgcccacgagctggctggctgcttgcacccacatccttctttctctgggacctggggtcgcggttacttgggctggccggcgaacccttgagtggcctggcggggagcgggcctcgcgcgcctggagggccctgtggaacgaagagaggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccatcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagt

SEQ ID NO: 292082 - DNA, 2544 bp, Homo sapiens
tgagacaaggttttactctgtcacccaggctggagtgcagtgatgtgatctcagtttactgcagtctcaaccccccaagctcaggtgatcctcacacttcggcccctgcgtgtagctgggaccacaggtgcatgtcaccactcatggctactttttgtattttttaattaagtacaatttccattttatttttctcaagagaatagtccgtcttcagactttaaggactcaactccttacgtgggctttggtgggggttgtggggcagcatccgcaggtctaaattggagtaggggtgttcagtccttgtgggcttcacaagatcgattcctgactactttgctgtgaattgcacaactcagacagtaatgtagcttcaaatacagcttgggaagcacataggcatcaaagacgctcgcttcagaaatgtccctgactgctgcagcctccactgtgtttccaatgatgaatttgttaatagccttgtccttgggcacacattgggcacagttcgtgtcgcaaataggctgcacgtggccgcggccctttttggtacgaccgttgttccttctttttttcatcatattggaggcacggactggaggaagcactaatttttgtatttttattagagatggggtttcaccgtgttgcccgggctggtctcaacctctgaggctcaggcagtcttcccaccttggcctcccaaagtgctggggttacaggtgtgagccaccacacccagcctgtttctgctttttaaagcaacagtaaatatatttttattttattttattttttgagacaggctcttactctgccaccaaggctggagtgcagtggtatgatcatggctcactgcagcctttggcttcgtgggctcaagcgatccccccacctcagcctcccaagtagttgggaccacaggttcaagccaccacgcccagctaatttttaaatttttttttgtagagatagagtctctctgttgctcaggctggtctcaaacagctgggttcaagggatcctcccaccttgccctcccaaggtgcttggattccaggcttgagccactgtgcctggccaacagtaaatatttgtgatttattttttcccaccctcactttccctggagaagttagctgggctgtagcaagctgcgctatccatggtcccacctagaattttggaggtggctcggctggaaggcacagctggccctcacggttattttgagcctaactgtaaatgtctctgagcctcccttgtgcattctttgtagaccccattaggaacgggcctctggggagtctcacctgtggcctcgcggagcacacctgggttggagcagaggccacggaggagtgccactgtgctctttagggttagctcgcgcctctttttcttcttagcttcaccctcagcctctatgttggccgtgggcactatggattgggactgatgttgcagttgcttttaattgagactagtaccctgaccaggcatacgtatctaaggacgtgggaccacacactgggtcctggtgtgaggcaaggcagggatccaaaaacaaacaggaattcaccaccctcgccttcagctcaacaaaggaaaggaaagtctctttgctttgccaatgcctgcataggtatctgttagtttatttctcttcctagagctggacctgagtgcctgtctttttaactgatggccatctacatcttttgaccctctgccttcttgactgtccatttttagctaatcaaaacccttcatgtcatatttggtagatgcgtgaccctcttttctctctgtgttttattcattaattccttcttaataaaatgagtatctgtaaacctgatatctaataatctgaatatatgtctatccacgtgctcctccctgcctctctccctccaggtaacctctggtttgaattttatgtgccaggcgtggtggctcacacctgtaatcccagcactttgggaggtcgaggcaggcagatcacaaggtcaggagatcgagaccatcctggctaacacggtgaaaccctgtctctactaaaaatacaaaaaaattcgccgggcatggtggtgggcgcttatagtcccagctactcaggaggctgaggcaggataatggcatgaacccgggaggcggagcttgcagtgagctgagattgcgccactgcactccagcctgggcgacagagcgagactccatctcaaaaaaaaaaaaaaaaatgaattttatgtttattatccctttgctctttctgaaagtagtttgatcacatatatatgactgcctaaacaatgttttgtttagttttggttgtttttgcactatataaaacaaacaggagcagcatactctgtgcaatcttttgagacttgcttttccactcagcagagacttcttgacgttgccatgtgtggctgtggggaagtactgttatgcatagtccattgtgaaaacgtatggcagtgtagccatcctcctgctggtaggcacttgagatgcttccaggttttgtttttt

SEQ ID NO: 292083 - DNA, 1610 bp, Homo sapiens
ttcaacctcaaaaaatgtctattgttatgccaccactatcccagcatgggggacctctaaccaatttgtcttatcttgactagtccttaatcaccttctgaggcctgaagggatgggctaaggacatcatacccccaacagtagaaaatgatctaatctcaaggtgggggagggtggttagagaaatcaaatttaacttttcttatttgaaacttgatctactgcccatggtatggggagaaagggagttagaatcctgaggtgcattaggaatgatccgggcctgaccagagacatgactatctctcccactcttatcactgacagccccatgatccagacagtcagaagaaactcagaaagaagtctatcacaaagactgtacaacaagcacgaagtccaaccataattccaagctccccagctgccaacctcaattccccagatgaactccaaagctcacacccctctgcaggtcatactccaggtccccaaagaccagccaaatcctaagagcccacctggaagtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtgggagtaaaagcaaatttggaaaataaacttttttttgttgaatcttttactgatctggattttccattcttgctatggctgcctcttgtaacacaattaggagaaggaaggtaggagaaaataaagtagggaaaagaaccatacagtggtttgggtggaacacatttttacaagaattgagtcagttatactccagaaatgaccaagagaaagttggtctgaatcatggaaaaagggcagaacctcaaagaaccagtccctcaaccctacccactcattttttatcctgagcatggacaactaacaactacaaaatcagaaatagaattgagtagagtatgtatatgtgtgtttggagaaggtggggaagaaaaggtagggaaaaccaaagtagaagatactatgcttgtgtaagactttctatctaagcccaagtacaaatatagtttgaaaattgaagatattaaagtgattggaagacagagaagaaaaagacagtaagtagaaatttaaggcagaataacaaacatgatgctctgtcacaccccccacccacccactaccatgcttcaatcacccaaatggtacgaaaccaccaaaaaattcaactgccctacccattttccagcctctaacagctgtttatcattgaccccattttatattttcctggcactggctgttaaatttaatgcccttgccaaacctttcccagtcccaatgacaaagtgttctgtcatgatcacttgtccctcattccaaggacaaagtagagaacagctggtttaaaatggaggaaaggtacaaggacttcccagggcccctctagtaaaaagggaaaaccaatcattacttaaagccaaatactatttgggaccctgaatgaagactgttaaaacagcgggtccccac

SEQ ID NO: 292084 - DNA, 1755 bp, Homo sapiens
  misc_feature (22)..(22): n is a, c, g, or t
  misc_feature (33)..(34): n is a, c, g, or t
  misc_feature (36)..(36): n is a, c, g, or t
  misc_feature (55)..(55): n is a, c, g, or t
  misc_feature (121)..(121): n is a, c, g, or t
  misc_feature (128)..(129): n is a, c, g, or t
  misc_feature (131)..(132): n is a, c, g, or t
  misc_feature (134)..(134): n is a, c, g, or t
  misc_feature (138)..(138): n is a, c, g, or t
  misc_feature (144)..(144): n is a, c, g, or t
cagcgtgacacgcataagcacngcttcatcagnntngatgctcttatcagtcttnccatgaagaagtctggagaagcttctgaatcttggggatacgagtagaaccaccaaccaggacaanatcatgnncnntnactncagtgncaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggcaaatccttggggttccttcatgggcacctggcaaatgcctctgaagataccccctgctcgggtgaccctgacctcccgtacaactgctggtgctgcctccctcaccaaatggatacagaaaaatcctgatttactcaaggcctccaatgggctgtgtcctgaaatcttaggcaagccccatgatccagacagtcagaagaaactcagaaagaagtctatcacaaagactgtacaacaagcacgaagtccaaccataattccaagctccccagctgccaacctcaattccccagatgaactccaaagctcacacccctctgcaggtcatactccaggtccccaaagaccagccaaatcctaagagcccacctggaagtccacgtatgctagaactctgggcagggcctaatctagctgaggtccagaaatacaaacctggaacttcatatggaccaagtggccacacactgaaaaacccgtatagcgactcagtgaaataaacaagagcccccagtcagaactgtgaaacagggaaattttggggtgggagtaaaagcaaatttggaaaataaacttttttttgttgaatcttttactgatctggattttccattcttgctatggctgcctcttgtaacacaattaggagaaggaaggtaggagaaaataaagtagggaaaagaaccatacagtggtttgggtggaacacatttttacaagaattgagtcagttatactccagaaatgaccaagagaaagttggtctgaatcatggaaaaagggcagaacctcaaagaaccagtccctcaaccctacccactcattttttatcctgagcatggacaactaacaactacaaaatcagaaatagaattgagtagagtatgtatatgtgtgtttggagaaggtggggaagaaaaggtagggaaaaccaaagtagaagatactatgcttgtgtaagactttctatctaagcccaagtacaaatatagtttgaaaattgaagatattaaagtgattggaagacagagaagaaaaagacagtaagtagaaatttaaggcagaataacaaacatgatgctctgtcacaccccccacccacccactaccatgcttcaatcacccaaatggtacgaaaccaccaaaaaattcaactgccctacccattttccagcctctaacagctgtttatcattgaccccattttatattttcctggcactggctgttaaatttaatgcccttgccaaacctttcccagtcccaatgacaaagtgttctgtcatgatcacttgtccctcattccaaggacaaagtagagaacagctggtttaaaatggaggaaaggtacaaggacttcccagggcccctctagtaaaaagggaaaaccaatcattacttaaagccaaatactatttgggaccctgaatgaagactgttaaaacagcgggtccccac

SEQ ID NO: 292085 - DNA, 691 bp, Homo sapiens
  misc_feature (22)..(22): n is a, c, g, or t
  misc_feature (33)..(34): n is a, c, g, or t
  misc_feature (36)..(36): n is a, c, g, or t
  misc_feature (55)..(55): n is a, c, g, or t
  misc_feature (121)..(121): n is a, c, g, or t
  misc_feature (128)..(129): n is a, c, g, or t
  misc_feature (131)..(132): n is a, c, g, or t
  misc_feature (134)..(134): n is a, c, g, or t
  misc_feature (138)..(138): n is a, c, g, or t
  misc_feature (144)..(144): n is a, c, g, or t
cagcgtgacacgcataagcacngcttcatcagnntngatgctcttatcagtcttnccatgaagaagtctggagaagcttctgaatcttggggatacgagtagaaccaccaaccaggacaanatcatgnncnntnactncagtgncaaccagtatgaaaaggctttctcatccaagtatctgcagaactggtctcccactaagccaacaaaagagagcatctcttctcatgaaggctacactcaaattattgccaacgatcgtggtcatctactgccttctgtgccccgttccaaggtgagatactatcttcactcctatcaagaaagtcaaataattaaggcacagaactgggagatgtgcagtctctcacagccattatcgggaaaattaaagtttaatctaattcatgttgtaatgtgagagcccctgaacttccggccagcttacccagcaggatagagttgtgtttagcacccttcagaagttcttaaattgatcaatgatctgtataaatgaaagccttcaggtgatgacatttgtgcagtgggtactcctttgccacactcggcctaaggatgtggaatttaagttggcagagtaaaggggatgaaaaaattaggcctgcaaagcctaaatgagggagggggataaggaagggtgggaagattatgctttcagtcttgtttcata

SEQ ID NO: 292086 - DNA, 1158 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292087 - DNA, 767 bp, Homo sapiens
cggacgcgtgggtcgacccacgcgtccggttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292088 - DNA, 1322 bp, Homo sapiens
  misc_feature (1164)..(1164): n is a, c, g, or t
  misc_feature (1169)..(1169): n is a, c, g, or t
  misc_feature (1172)..(1172): n is a, c, g, or t
  misc_feature (1176)..(1176): n is a, c, g, or t
  misc_feature (1182)..(1184): n is a, c, g, or t
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaacacccnccaangancacnccacannnaagggggggctcaatatccgggggccctctggcccctttttaagggccatgggttataaccgcgcgcaacccgcggacgctgtgctcggaccttcgggttggcaccctgccgaatagtttcaccgcggatgcgtatac

SEQ ID NO: 292089 - DNA, 721 bp, Homo sapiens
ggacgcgtgggtcgcggacgcgtgggcgaccacgcgtggggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292090 - DNA, 796 bp, Homo sapiens
cggacgcgtgggtcgacccacgcgtccggttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaagggcttgtgcactggagaaaaaagaaaaa

SEQ ID NO: 292091 - DNA, 554 bp, Homo sapiens
gggccaagaacggaggaaaggggaaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292092 - DNA, 1100 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292093 - DNA, 1202 bp, Homo sapiens
  misc_feature (1202)..(1202): n is a, c, g, or t
gcgggccctgggggagagcttggccgcgctgcggggagggggcggggtgcatgcgcgtgggagccgggccgcgggaaggggcgggccgcagcggcgcgcggtgggggcggagctggggcgcggacgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagatggtcatggatccggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccn

SEQ ID NO: 292094 - DNA, 776 bp, Homo sapiens
gagagagagagagagagagagagagagagagagagagagagagagagagagagagagagagagagagagagagagagagagaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292095 - DNA, 726 bp, Homo sapiens
aatccattcaggaaagctggtaactgtcaccaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292096 - DNA, 1410 bp, Homo sapiens
  misc_feature (1162)..(1162): n is a, c, g, or t
  misc_feature (1164)..(1164): n is a, c, g, or t
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaagcananaaaaaccgaaacggaaatacaggaaaaaaggggggggcgccactaaaagatccccggggggggccacaattggggacccccacaggtgggaaacagggggccccaaaagacgacggggaatatgagacacagagcagggccgccttatacaaagagggtggagcgtgggacaccgccgcaccggagcaccttggcagagcaccacacacgcggggggggcaccagtggggcagaacccgaggacat

SEQ ID NO: 292097 - DNA, 1332 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaaaaaaaaaaaaaaaagaaaggaaaaaaaaaggggggggggaaaaaatccgggagggcaagataagtaccgtttttaaaaggggcaaaagggggataaaaagaggggggtaaagggggggaaggcggggtttggaagcccttctggggtgtggccccaggagcggagaagttggga

SEQ ID NO: 292098 - DNA, 1261 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaacattgtctaaccggcacctcctgttagaacctgctcttttcaatggggggccccttcccctttacttggagaaaaataaacttcgggggggggccctgttccc

SEQ ID NO: 292099 - DNA, 1329 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292100 - DNA, 1245 bp, Homo sapiens
gcgggccctgggggagagcttggccgcgctgcggggagggggcggggtgcatgcgcgtgggagccgggccgcgggaaggggcgggccgcagcggcgcgcggtgggggcggagctggggcgcggacgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagtagggaagagtctccctggaactgttttctcctttcaggatgagggggatcgagcaagccactgtaacccctggcttggcttcctcttactatgagattgctcgtgggcccttagaagttccaggtcttcagccctaatctgcctttttttgggattcctagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292101 - DNA, 1033 bp, Homo sapiens
gcgggccctgggggagagcttggccgcgctgcggggagggggcggggtgcatgcgcgtgggagccgggccgcgggaaggggcgggccgcagcggcgcgcggtgggggcggagctggggcgcggacgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagattaagcctgatcaagatgacaacctcggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292102 - DNA, 1072 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccgccccatccgaagcagtgccgggatcctctagtcacctca

SEQ ID NO: 292103 - DNA, 1096 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtgggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292104 - DNA, 1002 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtacgcccgtacgaaggccaatgttaccg

SEQ ID NO: 292105 - DNA, 1277 bp, Homo sapiens
  misc_feature (1277)..(1277): n is a, c, g, or t
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagatggtcatggatccggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccn

SEQ ID NO: 292106 - DNA, 1101 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292107 - DNA, 1265 bp, Homo sapiens
  misc_feature (1107)..(1107): n is a, c, g, or t
  misc_feature (1112)..(1112): n is a, c, g, or t
  misc_feature (1115)..(1115): n is a, c, g, or t
  misc_feature (1119)..(1119): n is a, c, g, or t
  misc_feature (1125)..(1127): n is a, c, g, or t
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaacacccnccaangancacnccacannnaagggggggctcaatatccgggggccctctggcccctttttaagggccatgggttataaccgcgcgcaacccgcggacgctgtgctcggaccttcgggttggcaccctgccgaatagtttcaccgcggatgcgtatac

SEQ ID NO: 292108 - DNA, 558 bp, Homo sapiens
aatccattcaggaaagctggtaactgtcaccggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccgtattcgctcagcccgcacggtcatttggtagctgatgttgaacgttggtcgtgttatga

SEQ ID NO: 292109 - DNA, 1505 bp, Homo sapiens
  misc_feature (1215)..(1215): n is a, c, g, or t
  misc_feature (1219)..(1219): n is a, c, g, or t
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaaaaaaaaaaaaaaaaaaaaaaccacaacaacaaaacaaaaaaaaaaaagggggggggnacanaaaggacacaccaggggggcacacggaagagaggacagcgactgggggggaggggggaaaaaaagaagagacaaaaaaaaaagaaaagaaaagaaacacagcgccccgaaggacaacaggaatacggacaagcgcaggaacaacaacagacgcgcgccaccaagcgaaaacacacaagagccaaaaagacagggacacaaaacagagagcgagccggccacacgagggaaaaaagagcagaagaaagaaagggagaagaaaacctaaagcgcagaaaccaacacac

SEQ ID NO: 292110 - DNA, 1083 bp, Homo sapiens
gcgggccctgggggagagcttggccgcgctgcggggagggggcggggtgcatgcgcgtgggagccgggccgcgggaaggggcgggccgcagcggcgcgcggtgggggcggagctggggcgcggacgtgaaccccgcgggcggggagcgggtgtgcgcagcgctaggtgtgcgcttcgccctgtaggtagagagaccctttggttagctttccacgccaagtggccgttccaggcaggcagtgtcgtcttggttcagccaaggtcacagagggagtgatagcttccgcgcagccctggctacggactctgggcatctttccactgccccgcttgcgccacctgttaggcaggatcgtttttcctctggggcaagatcaaaatccaggtcctgcaggaagaaactcctcttaaaaatagattaagcctgatcaagatgacaacctcccaaaagcaccgagacttcgtggcagagcccatgggggagaagccagtggggagcctggctgggattggtgaagtcctgggcaagaagctggaggaaaggggttttgacaaggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292111 - DNA, 1018 bp, Homo sapiens
ccagtgttcccagttcccaccagtccaactgcgaggagtgcgacgtgagtctgagtctgatccctccgaaaaccgtacttccggcgctgtctcggaggcctcccgtcccctcccttgtccgtcttctaactcttccccacgccaggtccgtcaagcctaagtccttgagttccgggtccgggcagcagagaaaggaagtcctctccctggaggcctatctccctcagaactgcgcgagaagcgagaccttagaaggcagcgcttcccgcgaaggaccggaaaggagcgcctactaaggacgccgtcgaggtccggggcgcctcaactctatagctctaactggctagaagtgcccaacgtggaatgtttcttttttaaaggcggctcttgaagcgacccggaagcggaagtggaagaaagttctagtggcttgaggtatccgcaggagcggccgggtggcgggaggaaccgttacgggaactgaagttgcggcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292112 - DNA, 695 bp, Homo sapiens
gcatatctagaagaggctgcagatcctgggcacctgtggagaggagaggggggcaaaacccgcgctgcttcctgggcttgtgtgctctgaatggcacaggaatggctgtcttgctcttatctctcactgagcactgagcagcacgctccctccttttccctgttttgcgcctatgttgtccttggccagtttctggtgctaaagaaagatgaagacctcttccgggaatggctgaaagacacttgtggcgccaacgccaagcagtcccgggactgcttcggatgccttcgagagtggtgcgacgccttcttgtgatgctctctgggaagctctcaatccccagccctcatccagagtttgcagccgagtagggactcctcccctgtcctctacgaaggaaaagattgctattgtcgtactcacctccgacgtactccggggtcttttgggagttttctcccctaaccatttcaacttttttttggattctcgctcttgcatgcctcccccgtcctttttcccttgccagttccctggtgacagttaccagctttcctgaatggattcccggccccatccctcacccccaccctcactttcaatccgtttgataccatttggctccttttttggcagaacagtcactgtccttgtaaagttttttagatcaataaagtcagtggctttcaaaaaaa

SEQ ID NO: 292113 - DNA, 563 bp, Homo sapiens
aaaactgaggaagaaaactgacaaggttttcaagggaatttccaggctgagaatctacgatggccagtgagctggtatgattcatacgaagttccatgtctcacttatctctccaaatcatggttcttcacgagggagcccttcttcaggctgttcttccgctccacgtagttggacggtacatagcccgtcctgttggccgcgttcctcacccgccaccacgtcttggagtcgtccagcaaccacagccgctcgttcttcttgatgtccagctcctggtcctgctgggcggtgtagtcccacttggctatcacaataacttcttctgtcatctttcatggagtccttctgccagcaaaacatttggagatgctcattagagaactacccggacacttcatcctttgcaccaacttgaaaaattaggcactgacagcttttattacaactctgcaaccagttttctcctgggtcttgaaatgctcaactttaaaatgaccttctttcaacaagctttagtatttggtttagaaacagcaaccttataaaacaaatcttatgtt

SEQ ID NO: 292114 - DNA, 440 bp, Homo sapiens
agataccttaattttctctacccagtgtttattcaaccaattctgactcaagtttcagagccaaggtttatatgtgtacctgtgaatgcacaggcacgtgtgcatatgaaagagagaaaaagagatggattctatttatgcgaacatacagcaagaatggggcctctataaacggtggcttccacttgctggcacaagttgtcagggaaagcagagcctttggaaggtatcctcagcagtgtgcctcctactggttttaaaaataatctcacacattccggattttgacaacctttcgctttttaccttcaactgtacttcagataccaccttttctgttgtgagtagaaacttctaggtagggagttccgacgcatcaacacctgcagatgtgaaaacaacctaacaatttttactcacagagaagcatccaaagaaag

SEQ ID NO: 292115 - DNA, 507 bp, Homo sapiens
gatctcggtccaaagaggctccacttatctgacaagtttctgtccttatccccacttccagagtccatggtgctaggatttgggccaggcctgccacgccactgcttaacccaagctgcacaccaaacaatgatcacgtttgaattttctcaaacgctcaacagatccattcatgtgttactgatgctgccggtcccaagaccacaccttgaggaccactgctcccaaggttcaagtaatggtcttttgaaacaaacaaaaaaaatctacttagctcctcattttcaacctgcaagagctggcagcctccaccttctgcaatcgaaacacctgataccttgctcaggcctagcagggaggagagaacaagacttattctttattctgtgcttgtctggaagaactgagaagaaagtaagatggttgaaaaggggggacagataaaaagtaatgaaaaatgttgtatccttactacaaaacagaatttatacctttaagctgtgaaaa

SEQ ID NO: 292116 - DNA, 545 bp, Homo sapiens
  misc_feature (13)..(13): n is a, c, g, or t
  misc_feature (67)..(67): n is a, c, g, or t
  misc_feature (401)..(401): n is a, c, g, or t
  misc_feature (545)..(545): n is a, c, g, or t
cctgtattcaccnagacaccctgcccctctactgtctgcttcagaagatgcactcttagcgcttgtngcagtcgcgtcactgcctgccgtgtcatgcgcagggacgtacatctggcctcggtgaacacctgaaatgtcctgggtacactcatgtttattcacatatgggggctaaagccaagggctcaaagcttttatcagcctcccaaagggaaacagctgtagaaaactgtgagatccctgctccttcgagtctgagccttcatcatactcacctgacatactcagaggggttctctctgctccaccagagctgttccatagaccaccttgtctaaggccaagtggactggattagatgatctccctggagcaccaagttttcaggacttccgtggagnaccaagtccccagaaccccactatgggggctcagccctgctacctgccccgagtcacttgtgggactgacactgacaaagtctggtgattacactgcacagagccatcaccactccaatggtcacacccattcttctccccctn

SEQ ID NO: 292117 - DNA, 367 bp, Homo sapiens
cataaattccagcagatggggaatgtggtccaagacttctcaagaggtgagaaattctttggcatatgtttgggaattcgtgaaatcaatcttttgaaagaatgggggcattccttcaaaagatgcagtaccatctgtaacttaccaggcagagtttctaccaaaatttccacaacctttaaaatcagagtggaatggccaggtgtggtgcctcacacatgtaatcccagcactttgggaggccgaggtgggtggaccacaaggtcaagagatcgagaccatcctggccaacatggtgaaaacccatctctactaaaaatacaaaaattagctgagcgtgttggcaggtgcctgtattcccagctac

SEQ ID NO: 292118 - DNA, 1469 bp, Homo sapiens
tggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccgtgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgataaaaaaaaagagggggggataaaaaaccggagggccagataggtaccggctttggaaaaaggcccaaggaaggataaaaaaggaaggggggataagagggcggaaagtgtgatgtgggaactcggggggagggagaacaaagggaaaaaaggtatgcattaggggagtggtatagaagaaagaagaagagtgggagggtaaagagaatgaca

SEQ ID NO: 292119 - DNA, 1258 bp, Homo sapiens
tggaaaagtattggagttaatctgtattatatttatatagtccatatggcacatttgattcttccacatatattttgtgttaatgtttaggtatgatttttttctaaattctagaaaagaacataatttcagttatcagaagccattccatcattatagaccctttttcattatttcatttgctctcatatatcagtattatttttgagcattttgttacatgtcattcacaacttacctaagtgtgctgtgttctggtagcccgtatttgaggtaagctgctgaaaacaaaagtctctatattctttgcctattccaaagagctaaaaaagtctaacccaggaaagcttttgatattttgtgtttgttttcttgttcttatggttgttgttgctgtattatgattgctgttttacataaaatctatgggaactgtgaatacagacaagagagccacagtagagaggcttgtttaatgcagtaccattggagagttaacagaataatctagtagaaaaataactggttgcatgtaaaattccttccagccagaaagaaagaaagacaaggagtaagggggatttagagttatgtctcagctacacattacattgtgatactgcagctcaaattcagaatggcaatgatacatgatatcatggcctagatccttgagagggacctggctttcctttttaaaagatattttactgaagagctaaaaactggccagtgtggggttagcagatcgaataacttgaaatagaccgtgcagtattcctagcactcaatgtaatcaccctatttgtgacagagaaagggaaaaaaatataataagatcatctacctataatttgaataattttgagctatcaaaatgtctttgtaattttcacaaccgctgtccattgtttgaggatgttacctactaaactgaaaacattcattccatatctacttacacatacaccagcaacagtataaatgtaagcctaactttgcaaaattcgtaataatttagtgatggaattttttaataacatgcagtatataaatgtgcagattttatgcgtgttgacaaaatcatttttcagcttgcaaaatgggactgcaatattacatttttcacttaagcagttttttacatctacgttgttgctttctaaaatgaatgtgaatgccatcttttatgactgcaacttgccttttccattacagaaatttttgtttgatgtaatcaataaactttggtatgata

SEQ ID NO: 292120 - DNA, 504 bp, Homo sapiens
tgagggtaatgaatttatgaagtactcgaattaacatttatacccgccttgtctatagtatgaaaacctctggactcacgtgattgccatcatgtgccacgttgatgaaattgagctcttagataatcagagtcaatgttgattaatatttttatattttatcacattgtaatttgttaacattgctgaagagtgttatacgtgatcagtaacttgcatgattaataagcattgatgtttatacatattcgtttgttttctaggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagt

SEQ ID NO: 292121 - DNA, 1147 bp, Homo sapiens
cccagcgcctcggaggtgctgacgcggcatctgctgcagcggcgcctgccgcctggacctccttctgcgtgccctacagcgccgtccgcaacgaccagttcggcctctcgcacttcaactggccggtgcagggcgccaactaccacgtcctgcgcaccggctgcttccccttcatcaagtaccactgctccaaggctccctggcaggacctggcccggcagaaccgcttcttcacggcgctcaaggtcgtcaacctcggtgagtggcgactgccgcgcccacgcggtgaagcccgcccggccgggacggcccctcagccaccgagcacgtgacgaacgctcgcaggccggtagagtcccgcgggagtcagctctgcctcccggcgccggcttcgcctggggtcctttgtactcctcgcccagggggtccccagcttgctgagctcctggcacccgaagccgttcgcctgctgcgggcgcgtcctcgggcctagggaggggcgggtcgccctcctgtcctgcccatgttaaccagagtagacccctggcctgggcagtaagccagggggcgtcaggaaacgccccctagaaagtggctctgaagttgacatccgtcctactgcatggcaggactcattcccgtgaacatcactttgcagctgcgtttatgttgcaataactggaactactcttttaagtttcttttgttttctttgtatgaattcccggcaagttcgttttactaaaagcaccaaaggttttcaccagacataacagcttcctgaggtgctaggcctaaaagatttttaaagatctttaatatttgtatattttcatggagacgccctgaggatgtttactgtcactaggtgtttattttcttttggtttaatgacagaagagggaggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagt

SEQ ID NO: 292122 - DNA, 1109 bp, Homo sapiens
cccagcgcctcggaggtgctgacgcggcatctgctgcagcggcgcctgccgcctggacctccttctgcgtgccctacagcgccgtccgcaacgaccagttcggcctctcgcacttcaactggccggtgcagggcgccaactaccacgtcctgcgcaccggctgcttccccttcatcaagtaccactgctccaaggctccctggcaggacctggcccggcagaaccgcttcttcacggcgctcaaggtcgtcaacctcggtgagtggcgactgccgcgcccacgcggtgaagcccgcccggccgggacggcccctcagccaccgagcacgtgacgaacgctcgcaggccggtagagtcccgcgggagtcagctctgcctcccggcgccggcttcgcctggggtcctttgtactcctcgcccagggggtccccagcttgctgagctcctggcacccgaagccgttcgcctgctgcgggcgcgtcctcgggcctagggaggggcgggtcgccctcctgtcctgcccatgttaaccagagtagacccctggcctgggcagtaagccagggggcgtcaggaaacgccccctagaaagtggctctgaagttgacatccgtcctactgcatggcaggactcattcccgtgaacatcactttgcagctgcgtttatgttgcaataactggaactactcttttaagtttcttttgttttctttgtatgaattcccggcaagttcgttttactaaaagcaccaaaggttttcaccagacataacagcttcctgaggtgctaggcctaaaagatttttaaagatctttaatatttgtatattttcatggagacgccctgaggatgtttactgtcactaggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagt

SEQ ID NO: 292123 - DNA, 499 bp, Homo sapiens
cccagcgcctcggaggtgctgacgcggcatctgctgcagcggcgcctgccgcctggacctccttctgcgtgccctacagcgccgtccgcaacgaccagttcggcctctcgcacttcaactggccggtgcagggcgccaactaccacgtcctgcgcaccggctgcttccccttcatcaagtaccactgctccaaggctccctggcaggacctggcccggcagaaccgcttcttcacggcgctcaaggtcgtcaacctcggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagt

SEQ ID NO: 292124 - DNA, 1026 bp, Homo sapiens
cccagcgcctcggaggtgctgacgcggcatctgctgcagcggcgcctgccgcctggacctccttctgcgtgccctacagcgccgtccgcaacgaccagttcggcctctcgcacttcaactggccggtgcagggcgccaactaccacgtcctgcgcaccggctgcttccccttcatcaagtaccactgctccaaggctccctggcaggacctggcccggcagaaccgcttcttcacggcgctcaaggtcgtcaacctcggtgagtggcgactgccgcgcccacgcggtgaagcccgcccggccgggacggcccctcagccaccgagcacgtgacgaacgctcgcaggccggtagagtcccgcgggagtcagctctgcctcccggcgccggcttcgcctggggtcctttgtactcctcgcccagggggtccccagcttgctgagctcctggcacccgaagccgttcgcctgctgcgggcgcgtcctcgggcctagggaggggcgggtcgccctcctgtcctgcccatgttaaccagagtagacccctggcctgggcagtaagccagggggcgtcaggaaacgccccctagaaagtggctctgaagttgacatccgtcctactgcatggcaggactcattcccgtgaacatcactttgcagctgcgtttatgttgcaataactggaactactcttttaagtttcttttgttttctttgtatgaattcccggcaagttcgttttactaaaagcaccaaaggttttcaccagacataacagcttcctgaggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttttctttctacagt

SEQ ID NO: 292125 - DNA, 832 bp, Homo sapiens
ttactcctcctagaagcaatggaaccttgcctgttccctgggggtgagacggatgactgcccctacattagctacctaacatttttgcttctccggacagaagagtaagggcaaggggacaagacccatctccccaaagcagctgatccccacttgcacaccaaactaccaatgaagctagccatttctggtctcccatcctgacttttctgagcacatggtgaagatctgtggaaaacattttgatgaagagagagtccttggaaggtgtcatcaggtattgaccaaacaagccactgtcctggatttgcctgtttttccggttccaaggccattcttctgccttgagtggttccttgagactctttatcatcttgaccttcccagaagagagctccacaaagagcacatcagtttgtgtgcttgaactaccgtagatgttatattggtgggcttcagtaaaggatggttgaaatgccagatcagatatgtgcagatttgtgtaaatatcaaaagcctcctgtatttctcctctgatggtaatgtactgaacccttacaagacctttcacatcattaatgctgacaaggtagtggccatctggagagacatatggagtgcccgtcacatcactattgaacccaatgactgagtcagttacaccgtccaccatgacctgtggggaaactgctccggtgctgtcaggtttgcagccaatgaagtagtagcctcccaagtgtgtatatgccaatgactgaggaacgcacttatagtccttcaagttaattgtcttgatgtatgacatggtttcaagatcaattttttgtagtgc

SEQ ID NO: 292126 - DNA, 530 bp, Homo sapiens
attgttgtctttgaacatagcaatgaagagttatttttatttgggaaaaagtgtagaaataagaaaatagcatagtaaggctgctcttgactttcgtacagcttcagccttttcatgaaacataactcagatgatcttcttctgaattagtgaaccctgatgttagttatataaccaggggaccacggtgtcagccttgttattttaagggtcttttccagtctgcaagacccaaccaatttccttcacctttcacatgtggacttctcattgttactaaactaaccatcccttcctgctcatctctacacatactttaggacttattgatttcatggacgttcatttgtctcacaaacttggtgatatagaaactgcattttctgctttggtgcaccccttagagagcctagtgtggttcagacaaacctgatgagatgcacaacttggaggtctcgattttctcatctgtaaaactgggcaagttgttataaggattgtgatactatacaggaaagtgctaaataccg

SEQ ID NO: 292127 - DNA, 431 bp, Homo sapiens
taattaccagagagtagggccagggaagaagcttctctaactcaagaaccctctcttctgctgctcaccaggtctgaatagcccttgtgaaggcagcatttgagagaacttctctgccacatgctgattcctctcaccgcgggaagaaaccaacctaccctggggagcctgagagctctttgagtatctgggggtgaatcaactaatctgattaattgttttcagaggtgaggagctgggtactgaggaagggaaaattttgatgagaaagaatctgggcctttagcatgtgaaacatgaggctcagaatttaatgacttgttcaaagggagatttttaatagacatgctttaaccagctattttggacatcttatacaggtgagaagagaagggggatagcagttggccaagctataaggacacttaaaa

SEQ ID NO: 292128 - DNA, 425 bp, Homo sapiens
taattaccagagagtagggccagggaagaagcttctctaactcaagaaccctctcttctgctgctcaccaggtctgaatagcccttgtgaaggcagcatttgagagaacttctctgccacatgctgattcctctcaccgcgggaagaaaccaacctaccctggggagcctgagagctctttgagtatctgggggtgaatcaactaatctgattaattgttttcagagttaaaaaggcttagtcctggaaaagtcgaagaggtgaaaacctgcctggggaggctgctgaaggacgccaggaagaattcttatctccaaattcaatcctgcctcccagctagctgctggtgtttgaaattccaactctgaagtggtagtctggtatcttcttttaaaatgtggaagagagtaaacaaagttattcac

SEQ ID NO: 292129 - DNA, 990 bp, Homo sapiens
acagtcagcagctgacagaataatccacacattggtttccttacctatggagtgagggctattatggtggaaaaggccaagtagaagccactagaactatctgtacttaggaaaatagtaaaccaaaagcaatgctcaattcctatagggactgaagagattagtgccaccataagtacttgaaggaaggcggggtggtgattcctaccatatgtccattcaactcgcctatttagcctgggcagaagacagatggattatcacaaacttaactaggtggtgactccaattgcagctacagtaccagatgtattgcttgagcaaattaacacaactcctggttcctggtatgcagctacctggaatcttgattgccttttctttccacatcacattggtccattacattgacgacattatgctcactggacctaatgagtgagacatagcaactactccagacctattggtaagacatttgcatgtcagaagtgggaagtaaatccaacaaaaattcaaaggctttttcatgtctcagtaaaatttctaggggtccagtggtatgaggcatgttgagataccccttctaaggaactgacttcacctgcaacagagcttggagaagctgaagcctaagggtgctctaaagcaggggtccccaacctccgggctacagaccaatacccatccaaggcctgttaggaacccggctgcagagcaggagcttttctgcatggaagaattaaattgagaaaaacatagttatttaaaaaatcacatcgtaactgagttaacaaggcactgaggttctaatcatagattaccttccttcttcatcttccagctgttttctaaagtcttcctcctgttgcttgagttggttctgcaaatcagttattttttgaagaaaagaaactgtgatttctttaatttctgtttcctttagtgctgacttggtctgcagatctagaagcatcctttggtttgaga

SEQ ID NO: 292130 - DNA, 868 bp, Homo sapiens
acagtcagcagctgacagaataatccacacattggtttccttacctatggagtgagggctattatggtggaaaaggccaagtagaagccactagaactatctgtacttaggaaaatagtaaaccaaaagcaatgctcaattcctatagggactgaagagattagtgccaccataagtacttgaaggaaggcggggtggtgattcctaccatatgtccattcaactcgcctatttagcctgggcagaagacagatggattatcacaaacttaactaggtggtgactccaattgcagctacagtaccagatgtattgcttgagcaaattaacacaactcctggttcctggtatgcagctacctggaatcttgattgccttttctttccacatcacattggtccattacattgacgacattatgctcactggacctaatgagtgagacatagcaactactccagacctattggaactgacttcacctgcaacagagcttggagaagctgaagcctaagggtgctctaaagcaggggtccccaacctccgggctacagaccaatacccatccaaggcctgttaggaacccggctgcagagcaggagcttttctgcatggaagaattaaattgagaaaaacatagttatttaaaaaatcacatcgtaactgagttaacaaggcactgaggttctaatcatagattaccttccttcttcatcttccagctgttttctaaagtcttcctcctgttgcttgagttggttctgcaaatcagttattttttgaagaaaagaaactgtgatttctttaatttctgtttcctttagtgctgacttggtctgcagatctagaagcatcctttggtttgaga

SEQ ID NO: 292131 - DNA, 1160 bp, Homo sapiens
ggcgtagaaccgtccctgtggttggcacagcatggccggacgatcgatatgaccagtggatcaatactatgctaatcaccttgtaagaagtacgtgccccgtgaatctatatgacgtggctcatgtctctagccatgataacgacaattgtactgcgtgacggaatgaacgaagatgatccggagagactattgcacggacatgaatgtatcactgacgtgtattgattacacatgcaattcataattatgcagtgcttgtgcgaagatgatggcatacgaatattgatgatttactatcgaccctggatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccaccaagatgcagaactctttcaggacttcttttgctccattattctcacagatacttactgatttttcttttctttaaattggtgtttccttgtagatttttttaagtgcggtcttctgtcttgtgaattatttaaagtaagcatgtcttaccttcacttagcacacatttgcagtgcacctactgtgtttgaggcaccaggtttgagtgctgggaaccagagttttatcaaaatgctttctgggccagacatggtggctcatgcctgtaatcccagcactttgggaggccaaggtgggtggatcacctgaggtcaggcgtttgagaccagcctggccaacatggtgaaaccctttctctactgaaaatataaaaattagccaggcgtggtggcgcatacttgtaatcccagctactcaggaggctgaggcagtagacgcttgaacccaggaggcagaggttgcagtgagccaagatcacaccattgcacttcaacctggtcaacagagcgagactccgtgtcaa

SEQ ID NO: 292132 - DNA, 673 bp, Homo sapiens
ggcgtagaaccgtccctgtggttggcacagcatggccggacgatcgatatgaccagtggatcaatactatgctaatcaccttgtaagaagtacgtgccccgtgaatctatatgacgtggctcatgtctctagccatgataacgacaattgtactgcgtgacggaatgaacgaagatgatccggagagactattgcacggacatgaatgtatcactgacgtgtattgattacacatgcaattcataattatgcagtgcttgtgcgaagatgatggcatacgaatattgatgatttactatcgaccctggatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttgatttgcagataactcacaacttcttaagctaaatggtattttcatttttctcaagctctccaataaatatgaccattcagttcaaattcaagggggatcctcatagagtcag

SEQ ID NO: 292133 - DNA, 1304 bp, Homo sapiens
ggcgtagaaccgtccctgtggttggcacagcatggccggacgatcgatatgaccagtggatcaatactatgctaatcaccttgtaagaagtacgtgccccgtgaatctatatgacgtggctcatgtctctagccatgataacgacaattgtactgcgtgacggaatgaacgaagatgatccggagagactattgcacggacatgaatgtatcactgacgtgtattgattacacatgcaattcataattatgcagtgcttgtgcgaagatgatggcatacgaatattgatgatttactatcgaccctggatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattggcctctctaaaagtacaaaacattcataagagaaagcctgcatacattttgagaggccactgtacaaagtctcccgttcttcagagagagagagagagagagagagagagagagagagagagagagacagagaggacgtgaaaagcacgacattgagcgacatggaccgagcaggcaggaccaaacaccgctgagctcgtcgctgaggcaggagcctgacccaaggaagaagctgaccacgaagacgtgctctaaccagcagaccgcacaagtgcgaggcaatgaggcccatcccgtctctgatcagcagccaggtctccaggatagctgcattatgcctacagcgcacattacatcagatccggtggacgcaacaagaggagctggttgtacagccgggatcccctgacgagaggacgtcctggaaaagactctcctcctctctacatcacaatcttaaccaaacaccttggacccagctcaatgcgcttatacagcacctacctgctactagtcaccagaagaaccactgtgatgaccgcggcagaaccaggaacgctacgaacccataaccaaagacaagacgaacagaaagcacacaaaccaggaaagccaagcgacgactgagctgagaaaaagggacacacaagaaccacaaagacacgaaacccagagactacccaacaaaatcaagacgacagcccccacaacaagtcaaacaacaaccaccacaaccgacacagacaaaaagcaaaatgggcaaaagacctacataaaacaaaacaaacacaa

SEQ ID NO: 292134 - DNA, 477 bp, Homo sapiens
tcattccagtcatcctagccgtcgtagagcagagaattgcccttctgactccttgacagtggcccaaaaaatggttgttgttttatgctactaagttttgaggtggtttgttatgtagcgttcaataactagaactaggagttagaatgcttctcttgaggagctgaatggcttcagggtggtggttctcaacagggtgattttgtcccccaggggacatttggcaatgtttacagacattttggttatcacaactctgggaggggggttactactggcatttagtaggcagaagtcactggtgctgctaaacattctacaatgcatgagacagcctctgacaacaaggaattctttggcccaacatgtcactagtaccaaggttaagaaacctagctctagagaaaaggtgctcattggaggcttgttaactaaaagactgtcttgcttcctgtagtgaaaccccagttgataaat

SEQ ID NO: 292135 - DNA, 1786 bp, Homo sapiens
cctgatacgccccggattaacgggatgggcctggcggatgggattattaaagcttcgccggagccgcggctcgccctcccactccgccagcctccgggagaggagccgcacccggccggcccggccccagccccatggacctccgagcaggggactcgtgggggatgttagcgtgcctgtgcacggtgctctggcacctccctgcagtgccagctctcaatcgcacaggggacccagggcctggcccctccatccagaaaacctatgacctcacccgctacctggagcaccaactccgcagcttggctgggacctatctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaaggtctaccgagctggggaggaggtacagtaggccctgtcctgtcctgtttctacaggaagtcatgctcgagggagtgtgaagtggttcaggttggtgcagaggcgctcatggcctcctgcttcttgcctaccacttggccagtgcccacccagcccctcaggtggcacatctggagggcaggggttgaggggccaccaccacacatgcctttctggggtgaagccctttggctgccccactctccttggatgggtgttgctcccttatccccaaatcactctatacatccaattcaggaaacaaacatggtggcaattctacacaaaaagagatgagattaacagtgcagggttggggtctgcattggaggtgccctataaaccagaagagaaaatactgaaagcacaggggcagggacagaccagaccagacccaggagtctccaaagcacagagtggcaaacaaaacccgagctgagcatcaggaccttgcctcgaattgtcttccagtattacggtgcctcttctctgccccctttcccagggtatctgtgggttgccaggctggggagggcaaccatagccacaccacaggatttcctgaaagtttacaatgcagtagcattttggggtgtagggtggcagctccccaaggccctgccccccagccccacccactcatgactctaagtgtgttgtattaatatttatttatttggagatgttatttattagatgatatttattgcagaatttctattcttgtattaacaaataaaatgcttgccccagaaaaaaaa

SEQ ID NO: 292136 - DNA, 1619 bp, Homo sapiens
cctgatacgccccggattaacgggatgggcctggcggatgggattattaaagcttcgccggagccgcggctcgccctcccactccgccagcctccgggagaggagccgcacccggccggcccggccccagccccatggacctccgagcagctgaactacctgggcccccctttcaacgagccagacttcaaccctccccgcctgggggcagagactctgcccagggccactgttgacttggaggtgtggcgaagcctcaatgacaaactgcggctgacccagaactacgaggcctacagccaccttctgtgttacttgcgtggcctcaaccgtcaggctgccactgctgagctgcgccgcagcctggcccacttctgcaccagcctccagggcctgctgggcagcattgcgggcgtcatggcagctctgggctacccactgccccagccgctgcctgggactgaacccacttggactcctggccctgcccacagtgacttcctccagaagatggacgacttctggctgctgaaggagctgcagacctggctgtggcgctcggccaaggacttcaaccggctcaagaagaagatgcagcctccagcagctgcagtcaccctgcacctgggggctcatggcttctgacttctgaccttctcctcttcgctcccccttcaaaccctgctcccactttgtgagagccagccctgtatgccaacacctgttgagccaggagacagaagctgtgagcctctggccctttcctggaccggctgggcgtgtgatgcgatcagccctgtctcctccccacctcccaaaggtctaccgagctggggaggaggtacagtaggccctgtcctgtcctgtttctacaggaagtcatgctcgagggagtgtgaagtggttcaggttggtgcagaggcgctcatggcctcctgcttcttgcctaccacttggccagtgcccacccagcccctcaggtggcacatctggagggcaggggttgaggggccaccaccacacatgcctttctggggtgaagccctttggctgccccactctccttggatgggtgttgctcccttatccccaaatcactctatacatccaattcaggaaacaaacatggtggcaattctacacaaaaagagatgagattaacagtgcagggttggggtctgcattggaggtgccctataaaccagaagagaaaatactgaaagcacaggggcagggacagaccagaccagacccaggagtctccaaagcacagagtggcaaacaaaacccgagctgagcatcaggaccttgcctcgaattgtcttccagtattacggtgcctcttctctgccccctttcccagggtatctgtgggttgccaggctggggagggcaaccatagccacaccacaggatttcctgaaagtttacaatgcagtagcattttggggtgtagggtggcagctccccaaggccctgccccccagccccacccactcatgactctaagtgtgttgtattaatatttatttatttggagatgttatttattagatgatatttattgcagaatttctattcttgtattaacaaataaaatgcttgccccagaaaaaaaa

SEQ ID NO: 292137 - DNA, 887 bp, Homo sapiens
gccccgtccaatcacgagaaagctccagggctttgtgacaagatgcagtcccaacatcctgtttcagtctaaccataacttgggtgttccgctccaaacacgacctctgtgtctgaacactcagcccactagcatttgtgattctgagtcctcagccgtggagaatcaggaggaaaacaggagttgtcactggtagagaaggaagcagcccaagggacaaaggtcacgatacggttacgcaaatggtgctggcccacaccctcctggagagaggcctggaagatgggggggtcattcagagaccccagttgttggggggacctgctttccaggagaagaaaggagcttcagaaccttcaatacctgctcctgtgccccaccaggctgtggcctctttcataaggaaagagcaataagtcttcaggagagaattaacatccaatggattcccagaaaacttttccctcgatgtaccagcaaacacctacaatgccctgaaaagccgcctctgcgaccccaatgcagatcacacgtcctgtcccagcccctgcagcctccacgcggcgggtgcactgccaggcacgggaaggcagcgctggcgagtagaactggcccatctcgcagataggaagctgagcctcagggacgtttcacgccttcgtcaaggtggtgagaggaggagcgggattgccgtgaaggtggtgagaggaggagcggggtttgctgcccgacttcagggatctgtcaccctcgtccagcagggttggttcttcccgaggctgggaggatgccaagcctggtggaggatgggggcggtggtgtggtgtggggagcttctgacttgcacatcctgagggaaccttctgcagctgatgtgtgaactggac

SEQ ID NO: 292138 - DNA, 541 bp, Homo sapiens
ttgctgctgtaatgtaagaaacgccttttgcctcctgccataattctgaggcctcacagccatgtggaacttcttcaggagagaattaacatccaatggattcccagaaaacttttccctcgatgtaccagcaaacacctacaatgccctgaaaagccgcctctgcgaccccaatgcagatcacacgtcctgtcccagcccctgcagcctccacgcggcgggtgcactgccaggcacgggaaggcagcgctggcgagtagaactggcccatctcgcagataggaagctgagcctcagggacgtttcacgccttcgtcaaggtggtgagaggaggagcgggattgccgtgaaggtggtgagaggaggagcggggtttgctgcccgacttcagggatctgtcaccctcgtccagcagggttggttcttcccgaggctgggaggatgccaagcctggtggaggatgggggcggtggtgtggtgtggggagcttctgacttgcacatcctgagggaaccttctgcagctgatgtgtgaactggac

SEQ ID NO: 292139 - DNA, 387 bp, Homo sapiens
aataaaaggccttcatgttctggcctttgcttctctactggcctcgtccctaaccctcccttctttgtcagtgtgcagttacactgaggaatttgtgggatgcgtcatgatctctgtaacttctagtctgttgatatcctgcttctcttcctggagtcctcctccttaagtctccctttcccattctttacctgctaatttttctggactcaacaaagccttcctggacctttttagtcaggtttgtgctactggaaccccttgtacatccttttttttttttttttcccgtgagacagagtctcattctgtcgccaggttggagtgcagtggtgcagtctcggctcactgcagcctccacctcccaggttcaagcaattcttctgc

SEQ ID NO: 292140 - DNA, 965 bp, Homo sapiens
aaggtcgcaccaccgcactccagcctgggtgacagaaagagacccagtatcaaataaaaaatcaaatttcacttaaaaaagaaaaagaaaaaattcttcctagggctgagctgacatctccctcccaatggcttcctacctctagctctcacagaaaagcaatactcaggccccagttgtgtctgacgtgttgcagtttgaagaatattccatccctaatggctggtaaatggtggggcctgcattcagctgcttgactctgggagagggtgcaggccttgcccgtttcacacatgacctgaccagctctgttttccttgttggagccacttcagaattgtaaaggcatctctcatttctctagagtcttctttctccaggacaaacactccgagtttttcagctgttccttgcaggacaggattctgggttctcaccatgtggaatctcttctctgtttgcttcttaccagctcaacaacgcccctctgaaagtaggactcttggaaatgaaccttgttgggagtaaagctgaaccttcacctctcctttccaggattctactccattcatacggcctcacactgaattaatgtttctagcagccacattactttgttacccaattgatctagtagtaaagtcttcccatctcttcatgtaccactggtttattgactcttaatgtaggattctacatttgtttgttgtttatcttgttagatccagcctgttgttacaatcttgtaggaagttaactggatcctgattctacatatagctgattgacattttggagggttttgcaataaccatttcccttcctgacagcatcctaacttcctttgggggacctgtgtctgttcccatgtgggcagtcttggccagaatgcagtcctagggccccctacagaagctgaggagtctggatccttcctctcacttccccttgtgaactcgctggga

SEQ ID NO: 292141 - DNA, 658 bp, Homo sapiens
aaggtcgcaccaccgcactccagcctgggtgacagaaagagacccagtatcaaataaaaaatcaaatttcacttaaaaaagaaaaagaaaaaattcttcctagggctgagctgacatctccctcccaatggcttcctacctctagctctcacagaaaagcaatactcaggccccagttgtgtctgacgtgttgcagtttgaagaatattccatccctaatggctggtaaatggtggggcctgcattcagctgcttgactctgggagagggtgcaggccttgcccgtttcacacatgacctgaccagctctgttttccttgttggagccacttcagaattgtaaaggcatctctcatttctctagagtcttctttctccaggacaaacactccgagtttttcagctgttccttgcaggacaggattctgggttctcaccatgtggaatctcttctctgtttgcttcttaccagctcaacaacgcccctctgaaagtaggactcttggaaatgaaccttgttgggagtaaagctgaaccttcacctctcctttccaggattctactccattcatacggcctcacactgaattaatgtttctagcagccacattactttgttacccaattgatctagtagtaaagtcttcccatctcttca

SEQ ID NO: 292142 - DNA, 829 bp, Homo sapiens
cgagcagagtcagggctgccagcgccgtaagcagcaaggggaagggcaggttgtagagcaccaggcccccgcgaacgcccagccgcgcctgcgagccgtaagggtcgtgtggttggcaagtcatttaacttttccaaacaaatctgcaaaatggagataacagcacctgcctcattgcgttgtgaagaagatgaaatgtttagcccggtgcccaacacccagttctcactctgtcatccaggctggtgtgcagtggtgcaatgtgggcttactgcagccttgacctccaggacaagtgatctcccacctcagcctccggaatagctgggactacagctcaacaacgcccctctgaaagtaggactcttggaaatgaaccttgttgggagtaaagctgaaccttcacctctcctttccaggattctactccattcatacggcctcacactgaattaatgtttctagcagccacattactttgttacccaattgatctagtagtaaagtcttcccatctcttcatgtaccactggtttattgactcttaatgtaggattctacatttgtttgttgtttatcttgttagatccagcctgttgttacaatcttgtaggaagttaactggatcctgattctacatatagctgattgacattttggagggttttgcaataaccatttcccttcctgacagcatcctaacttcctttgggggacctgtgtctgttcccatgtgggcagtcttggccagaatgcagtcctagggccccctacagaagctgaggagtctggatccttcctctcacttccccttgtgaactcgctggga

SEQ ID NO: 292143 - DNA, 296 bp, Homo sapiens
gacaagccctgcgtcaggaggttgagcacagaccatgtggacagcagtgtggttggcaagtcatttaacttttccaaacaaatctgcaaaatggagataacagcacctgcctcattgcgttgtgaagaagatgaaatgtttagcccggtgcccaacacccagttctcactctgtcatccaggctggtgtgcagtggtgcaatgtgggcttactgcagccttgacctccaggacaagtgatctcccacctcagcctccggaatagctgggactacaggtatgcaccaccacgcccaa

SEQ ID NO: 292144 - DNA, 462 bp, Homo sapiens
gacaagccctgcgtcaggaggttgagcacagaccatgtggacagcagtgtggttggcaagtcatttaacttttccaaacaaatctgcaaaatggagataacagcacctgcctcattgcgttgtgaagaagatgaaatgtttagcccggtgcccaacacccagttctcactctgtcatccaggctggtgtgcagtggtgcaatgtgggcttactgcagccttgacctccaggacaagtgatctcccacctcagcctccggaatagctgggactacagctcaacaacgcccctctgaaagtaggactcttggaaatgaaccttgttgggagtaaagctgaaccttcacctctcctttccaggattctactccattcatacggcctcacactgaattaatgtttctagcagccacattactttgttacccaattgatctagtagtaaagtcttcccatctcttca

SEQ ID NO: 292145 - DNA, 428 bp, Homo sapiens
gttgcagtgagctgagatcatgccactgtactccagcctaggtgacacagcgagactctggctcaaaaataaaaataaaaataatcaacaatattataacttgggatacctcaaaagttgtgttacatagctgttagtggccgggtggggcagctcagcctgtaatcccaacactttgggaggatgaggcagatggatcacttgaggccaggagttcaagaccagcctggccaacatggtgaaaccctgtctctactaaaaatacaaaaataaacccggtgtggtggcacacacccgtaatcccagctgctagaaagcctgaggaacgagaatcgcttgaatcccagaagtggagttgagtggagtcagtgagctgagatagtgccactgcactccagcctgggtgacaaagcaagcaagactcggtc

SEQ ID NO: 292146 - DNA, 1456 bp, Homo sapiens
  misc_feature (1)..(1): n is a, c, g, or t
  misc_feature (5)..(5): n is a, c, g, or t
  misc_feature (7)..(7): n is a, c, g, or t
  misc_feature (10)..(13): n is a, c, g, or t
  misc_feature (16)..(16): n is a, c, g, or t
  misc_feature (20)..(21): n is a, c, g, or t
  misc_feature (26)..(26): n is a, c, g, or t
  misc_feature (30)..(30): n is a, c, g, or t
  misc_feature (34)..(34): n is a, c, g, or t
  misc_feature (44)..(45): n is a, c, g, or t
  misc_feature (51)..(51): n is a, c, g, or t
  misc_feature (60)..(60): n is a, c, g, or t
  misc_feature (67)..(67): n is a, c, g, or t
  misc_feature (75)..(75): n is a, c, g, or t
  misc_feature (77)..(77): n is a, c, g, or t
  misc_feature (84)..(84): n is a, c, g, or t
  misc_feature (99)..(99): n is a, c, g, or t
  misc_feature (111)..(111): n is a, c, g, or t
  misc_feature (115)..(116): n is a, c, g, or t
  misc_feature (123)..(124): n is a, c, g, or t
  misc_feature (139)..(139): n is a, c, g, or t
  misc_feature (512)..(512): n is a, c, g, or t
  misc_feature (603)..(603): n is a, c, g, or t
  misc_feature (1455)..(1456): n is a, c, g, or t
ntttntnatnnnnttncttnnttttntttntttnttttgagacnnagtctngctctgtcncccaggntggagtgnantggcgtnatctcggctcactgnaacctccgcctnccannttcaagnnattctcctgcttcanctcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggnggagccacatttgtattataaataacctatcctaagaaatgatccatcacttctgttacattctattggttccacagataaacctcaatanagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaacttttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccnn

SEQ ID NO: 292147 - DNA, 1291 bp, Homo sapiens
  misc_feature (1)..(1): n is a, c, g, or t
  misc_feature (5)..(5): n is a, c, g, or t
  misc_feature (7)..(7): n is a, c, g, or t
  misc_feature (10)..(13): n is a, c, g, or t
  misc_feature (16)..(16): n is a, c, g, or t
  misc_feature (20)..(21): n is a, c, g, or t
  misc_feature (26)..(26): n is a, c, g, or t
  misc_feature (30)..(30): n is a, c, g, or t
  misc_feature (34)..(34): n is a, c, g, or t
  misc_feature (44)..(45): n is a, c, g, or t
  misc_feature (51)..(51): n is a, c, g, or t
  misc_feature (60)..(60): n is a, c, g, or t
  misc_feature (67)..(67): n is a, c, g, or t
  misc_feature (75)..(75): n is a, c, g, or t
  misc_feature (77)..(77): n is a, c, g, or t
  misc_feature (84)..(84): n is a, c, g, or t
  misc_feature (99)..(99): n is a, c, g, or t
  misc_feature (111)..(111): n is a, c, g, or t
  misc_feature (115)..(116): n is a, c, g, or t
  misc_feature (123)..(124): n is a, c, g, or t
  misc_feature (139)..(139): n is a, c, g, or t
  misc_feature (512)..(512): n is a, c, g, or t
  misc_feature (603)..(603): n is a, c, g, or t
ntttntnatnnnnttncttnnttttntttntttnttttgagacnnagtctngctctgtcncccaggntggagtgnantggcgtnatctcggctcactgnaacctccgcctnccannttcaagnnattctcctgcttcanctcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggnggagccacatttgtattataaataacctatcctaagaaatgatccatcacttctgttacattctattggttccacagataaacctcaatanagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaacttttttttttttttttacttctttttaattttttttttttttttttttt

SEQ ID NO: 292148 - DNA, 584 bp, Homo sapiens
agcaacatacgagggttccagtttctccacatcgtcctcaaaaccagttactgcccgtcttttgattctggccatcctagtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaacttttttttttttttttacttctttttaattttttttttttttttttttt

SEQ ID NO: 292149 - DNA, 796 bp, Homo sapiens
gcaggaccagcaagaccctagcagtgcttcctacaccacagctcaccatattatctgctctcagtttaaagacagacacttgtcagctatcagctcagtggacccaagtatttcccatttacaaaattcagtgtattttctttttccctttaaggtgagggcaccagctggggaaggcattcccacacaagagaacactcaactgtcattactctcaaggtattccgtggtccatggaggctggtccacttgacaaagcttccaaggtcttgtggctttgagtttctttgaccagctgagtttctgtacgggagtttccccaccatccaaggcttccgtaaagctgctagcccagctgctctcctgagctggttcctctaccatcttacagcccctctaccatctcggtgtccagactgcacaacctggtgaaacacttcttggactcttacctccaaaaagaaaaaaaagagcttgtatgtactcttttatggaccatagcagagatcacgaaaacaagaactgtgggctcagaaaactcactaggcaagcaagggagggacagactgtccaggaccacctacgtgggctaaggactctggagaacagggagctctggaagtggcgctggagcagaggaatgcaacaaaatctggatctggagttagtatggtagctgagaacaggacttccagctcagtgggaggccacagagatcagtgaagagactgctgcaaaagtcctcagagcccaactaggattggtgactgaaggagagtggaaagatgctttaaga

SEQ ID NO: 292150 - DNA, 3118 bp, Homo sapiens
  misc_feature (2227)..(2227): n is a, c, g, or t
cgctgaatccaagagtacaaatgaagtcactgggttcctgggaaagacatgaggctggagagccaggctggtaaacagacagcagccaaagcaggcctgaggatgaagaagcaggtcacagagcaaagtcactccataggaaccagctagtgaggctgcctgctctccactgggaactggacctctgatgatgaactttctccttgtgccatctactctttcatcaagcaaagcttcctgaagcatctgctgtatcaggagctctgctaagagacacagaagagactgtgactaccatttctatcagccaagtaggatactaacaaggctccaaggattaaggtcccagaaaggcctgccacccacagaactttcgagtctacaggaacacctggaggatggatggaaaggagggaccattccaatagcctgccttcctgggaaggagagacttttgcccaggattgaggagacctaagtcctatttccaactttgatgaagacagtggactcctccatgaacaatttactcatccttggacttcccactccaggactgagattacatttgtcctgttgcttccactgaaagaagagccagaaatatgccttagaattttggaagagaactgcccatcttcaaggatggatattggtctccccggagtcgctgacagggttcctggggaagaataagagctcctagcatcgttgatgtagcttcttttagatgggtggaaactcagatcctgctgatggagtacgtacaggcatgccttcaacaggaatagagacttcaggaggcagtgagcagattctagctctggcattgctggggtgaggatatgtctgccctcccaaccctcttctacttttggacttctaaaaagtacctggacaattcagagggaggtagatgactgaagtgtgattttccaaaggcagaaggaggctcgtcacagcctactttatccaaatgggcccttaacctgcagtcctaccagcctctcaaacagcgaaactttgcagctggcagagatgtgtatgacacacctgtgctgccaatcactgaagaaaccatgtcttgaggaacctaaggagaaaaactcagtggcaattgcttgtcagtgaaaacagtcgcggcacacagggagagatccactgaccctgtggggctggtccctacatctggcgatctgacgtggggctctccctcgctgtgtgaagttgcaccctgagtgtgggatcagcagaggagttcaacgagatattcctgaggattgcggtcaataaacttggtgaccttgaggatgttgcaggaagaagagagagggcctcgtttgggagctgttcacctctgtcctaatacagggcaccaggtcctgttccaatggcagacagcatgggaagccattaatgtgcctgagttctgcagtcagacagctggtgttggatcctctaaccaactctgtgactggacaggagttatagcctctttccaagtgaattatgaagagcaagagcaagtgtggataatatggaagctcattccaggatgttcaagctcagtcgcccccgccagcctgttcaccgtgttatcctgctgctctgctgccccactcctccaccagtcacgatggaagaagagatcgccacgcttgccattgacaatggctccagcatgtgcaaagctggctttgctggggacgatgccccccaagctgtgtttccttccatcgtcgggcgccccagacaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgtgggctatgccctcccacatgccgtcctgcatctggacctggctggcagggacctgacaggctacctcatgaagatcctcaccgagcgtggntacagcttcaccacctcggcccagcgggagatcatgccccacatcagggagaagctgtgctacatcaccctggacttcgagaaggagatggccacggccgcatcttcctcctccctggagaagagctagagctgcccaatggccaggtcatcaccatcggcaataagccatcccggtgccactaatgtggcaaagccaaaattttaaccaaatctgatttcagtgctctgacccagaaagttcttatgctcacatcagctattcagatgttaacatttggtattttaaattacagaatgatacatatctgagatagacctcttcaagtcttccttataaattagaaactaaagatttttcaaacagaaatactttcaacttttcaagaagctttaattttgtctcataagatgtgaatcgactggatctgttatttagaatgattagcacactgggagtactggcagcaaagcctttgaaattgataaaaatatgtgctgtaatcggacagagatcatccatttgttacgccattccaaagttccctgttattgcctgtgacatttcccaaatcatctagagattcaagctgttagaacagtttcttttatcagtcatctccagaggctcatcaaactgagaattgtataattttgtatttttaaatccatgtggcacttgccacagacagaacctttggaagatgatattgttggtgtctagcctttggttaagatcaacacttgatgggtgatttttaatattaataaaaacagctagcttaatgttaagtctttgttcttttaaaagactgaagagaagagaaatagagtaactacacttgtgatatcacctagtatatattaatacattaaatatgaaaattcagtg

SEQ ID NO: 292151 - DNA, 452 bp, Homo sapiens
gaagaagatagaccaaaaaaggagacagagagacagagagagagagagtgatagagacagagagagagagagagagaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcaggtgaggctcggcagacgcccgtgctcctcccgtcctttccccagtcattttctgcccggcttgatttctgacatttaagtgtttcttcactgtgcctagctgagcgcctctccacagggatcctctaacga

SEQ ID NO: 292152 - DNA, 1511 bp, Homo sapiens
  misc_feature (2)..(2): n is a, c, g, or t
  misc_feature (620)..(620): n is a, c, g, or t
cntaggtggaagcgacgtccccgagccgtgtttcttccatcgtcgggcgccccagacaccaggtgagtggatggcgccgcggggctcctgggttctgcgttgcggggtgggttcggtgtcgccggcgaggctgacgggtcgtcccctgccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgtgggctatgccctcccacatgccgtcctgcatctggacctggctggcagggacctgacaggctacctcatgaagatcctcaccgagcgtggntacagcttcaccacctcggcccagcgggagatcatgccccacatcagggagaagctgtgctacatcaccctggacttcgagaaggagatggccacggccgcatcttcctcctccctggagaagagctagagctgcccaatggccaggtcatcaccatcggcaataagccatcccggtgccactaatgtggcaaagccaaaattttaaccaaatctgatttcagtgctctgacccagaaagttcttatgctcacatcagctattcagatgttaacatttggtattttaaattacagaatgatacatatctgagatagacctcttcaagtcttccttataaattagaaactaaagatttttcaaacagaaatactttcaacttttcaagaagctttaattttgtctcataagatgtgaatcgactggatctgttatttagaatgattagcacactgggagtactggcagcaaagcctttgaaattgataaaaatatgtgctgtaatcggacagagatcatccatttgttacgccattccaaagttccctgttattgcctgtgacatttcccaaatcatctagagattcaagctgttagaacagtttcttttatcagtcatctccagaggctcatcaaactgagaattgtataattttgtatttttaaatccatgtggcacttgccacagacagaacctttggaagatgatattgttggtgtctagcctttggttaagatcaacacttgatgggtgatttttaatattaataaaaacagctagcttaatgttaagtctttgttcttttaaaagactgaagagaagagaaatagagtaactacacttgtgatatcacctagtatatattaatacattaaatatgaaaattcagtg

SEQ ID NO: 292153 - DNA, 1624 bp, Homo sapiens
  misc_feature (85)..(85): n is a, c, g, or t
  misc_feature (733)..(733): n is a, c, g, or t
tcatcttgggcctgtgttatcccattgagcatggcatcgtcaccaactgggacgacatggagaagatctggcaccacaccttctncaacgagctgcgcgtggccccggaggagcacccagtgctgctgaccgaggcccccctgaaccccaaggccaacagagagaagatgactcaggtgaggctcggcagacgcccgtgctcctcccgtcctttccccagtcattttctgcccatcttgatttctgacgggtcgtcccctgccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgtgggctatgccctcccacatgccgtcctgcatctggacctggctggcagggacctgacaggctacctcatgaagatcctcaccgagcgtggntacagcttcaccacctcggcccagcgggagatcatgccccacatcagggagaagctgtgctacatcaccctggacttcgagaaggagatggccacggccgcatcttcctcctccctggagaagagctagagctgcccaatggccaggtcatcaccatcggcaataagccatcccggtgccactaatgtggcaaagccaaaattttaaccaaatctgatttcagtgctctgacccagaaagttcttatgctcacatcagctattcagatgttaacatttggtattttaaattacagaatgatacatatctgagatagacctcttcaagtcttccttataaattagaaactaaagatttttcaaacagaaatactttcaacttttcaagaagctttaattttgtctcataagatgtgaatcgactggatctgttatttagaatgattagcacactgggagtactggcagcaaagcctttgaaattgataaaaatatgtgctgtaatcggacagagatcatccatttgttacgccattccaaagttccctgttattgcctgtgacatttcccaaatcatctagagattcaagctgttagaacagtttcttttatcagtcatctccagaggctcatcaaactgagaattgtataattttgtatttttaaatccatgtggcacttgccacagacagaacctttggaagatgatattgttggtgtctagcctttggttaagatcaacacttgatgggtgatttttaatattaataaaaacagctagcttaatgttaagtctttgttcttttaaaagactgaagagaagagaaatagagtaactacacttgtgatatcacctagtatatattaatacattaaatatgaaaattcagtg

SEQ ID NO: 292154 - DNA, 1440 bp, Homo sapiens
  misc_feature (549)..(549): n is a, c, g, or t
gaagaagatagaccaaaaaaggagacagagagacagagagagagagagtgatagagacagagagagagagagagagaccagggcgtcatggtgggcatgggccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgtgggctatgccctcccacatgccgtcctgcatctggacctggctggcagggacctgacaggctacctcatgaagatcctcaccgagcgtggntacagcttcaccacctcggcccagcgggagatcatgccccacatcagggagaagctgtgctacatcaccctggacttcgagaaggagatggccacggccgcatcttcctcctccctggagaagagctagagctgcccaatggccaggtcatcaccatcggcaataagccatcccggtgccactaatgtggcaaagccaaaattttaaccaaatctgatttcagtgctctgacccagaaagttcttatgctcacatcagctattcagatgttaacatttggtattttaaattacagaatgatacatatctgagatagacctcttcaagtcttccttataaattagaaactaaagatttttcaaacagaaatactttcaacttttcaagaagctttaattttgtctcataagatgtgaatcgactggatctgttatttagaatgattagcacactgggagtactggcagcaaagcctttgaaattgataaaaatatgtgctgtaatcggacagagatcatccatttgttacgccattccaaagttccctgttattgcctgtgacatttcccaaatcatctagagattcaagctgttagaacagtttcttttatcagtcatctccagaggctcatcaaactgagaattgtataattttgtatttttaaatccatgtggcacttgccacagacagaacctttggaagatgatattgttggtgtctagcctttggttaagatcaacacttgatgggtgatttttaatattaataaaaacagctagcttaatgttaagtctttgttcttttaaaagactgaagagaagagaaatagagtaactacacttgtgatatcacctagtatatattaatacattaaatatgaaaattcagtg

SEQ ID NO: 292155 - DNA, 1444 bp, Homo sapiens
  misc_feature (553)..(553): n is a, c, g, or t
aaagacatcagctaagaaaggaactgggtcctacggcttggactttccaaccctgacagacccgcaagacaaaacaactggttcttgccagcctctagagaaatcccagaaggactcctacgtgggcgacgaggcccagagcaagcgtggcatcctgaccctgaagtaccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgtgggctatgccctcccacatgccgtcctgcatctggacctggctggcagggacctgacaggctacctcatgaagatcctcaccgagcgtggntacagcttcaccacctcggcccagcgggagatcatgccccacatcagggagaagctgtgctacatcaccctggacttcgagaaggagatggccacggccgcatcttcctcctccctggagaagagctagagctgcccaatggccaggtcatcaccatcggcaataagccatcccggtgccactaatgtggcaaagccaaaattttaaccaaatctgatttcagtgctctgacccagaaagttcttatgctcacatcagctattcagatgttaacatttggtattttaaattacagaatgatacatatctgagatagacctcttcaagtcttccttataaattagaaactaaagatttttcaaacagaaatactttcaacttttcaagaagctttaattttgtctcataagatgtgaatcgactggatctgttatttagaatgattagcacactgggagtactggcagcaaagcctttgaaattgataaaaatatgtgctgtaatcggacagagatcatccatttgttacgccattccaaagttccctgttattgcctgtgacatttcccaaatcatctagagattcaagctgttagaacagtttcttttatcagtcatctccagaggctcatcaaactgagaattgtataattttgtatttttaaatccatgtggcacttgccacagacagaacctttggaagatgatattgttggtgtctagcctttggttaagatcaacacttgatgggtgatttttaatattaataaaaacagctagcttaatgttaagtctttgttcttttaaaagactgaagagaagagaaatagagtaactacacttgtgatatcacctagtatatattaatacattaaatatgaaaattcagtg

SEQ ID NO: 292156 - DNA, 1363 bp, Homo sapiens
  misc_feature (472)..(472): n is a, c, g, or t
gatcgtcaccaactgggtacttcagggtcaggatgccacgcttgctctgggcctcgtcgcccacgtaggagtccttctggcccatgcccccattgagcatggcatcgtcaccaactgggacgacatggagaagatctggcaccacaccttctacaacgagctgcgcgtggccccggaggagcacccagtgctgctgaccgaggcccccctgaaccccaaggccaacagagagaagatgactcagattatgtttgagaccttcaacaccccggccatgtacgtggccatccaggccgtgctgtccctctacgcctctgggcgcaccactggcattgtcatggactctggagacggggtcacccacacggtgcccatctacgtgggctatgccctcccacatgccgtcctgcatctggacctggctggcagggacctgacaggctacctcatgaagatcctcaccgagcgtggntacagcttcaccacctcggcccagcgggagatcatgccccacatcagggagaagctgtgctacatcaccctggacttcgagaaggagatggccacggccgcatcttcctcctccctggagaagagctagagctgcccaatggccaggtcatcaccatcggcaataagccatcccggtgccactaatgtggcaaagccaaaattttaaccaaatctgatttcagtgctctgacccagaaagttcttatgctcacatcagctattcagatgttaacatttggtattttaaattacagaatgatacatatctgagatagacctcttcaagtcttccttataaattagaaactaaagatttttcaaacagaaatactttcaacttttcaagaagctttaattttgtctcataagatgtgaatcgactggatctgttatttagaatgattagcacactgggagtactggcagcaaagcctttgaaattgataaaaatatgtgctgtaatcggacagagatcatccatttgttacgccattccaaagttccctgttattgcctgtgacatttcccaaatcatctagagattcaagctgttagaacagtttcttttatcagtcatctccagaggctcatcaaactgagaattgtataattttgtatttttaaatccatgtggcacttgccacagacagaacctttggaagatgatattgttggtgtctagcctttggttaagatcaacacttgatgggtgatttttaatattaataaaaacagctagcttaatgttaagtctttgttcttttaaaagactgaagagaagagaaatagagtaactacacttgtgatatcacctagtatatattaatacattaaatatgaaaattcagtg

SEQ ID NO: 292157 - DNA, 1082 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292158 - DNA, 1501 bp, Homo sapiens
cgtatctgctccatggcttcccacgtcagggtcctgggcggggcaccaggcgcctccatttgcctccgaattttctggaatcggattgcttgtttctgtcgtttcagggtgctgggggaagagaaccaatggcagaagccatgcgtggaagcagaatggatgtttgaagagcctcaggctaaatcatggagcgcccagccctcttctctttgatcgcaagggcaaccgggccatgttgccggcttagagctgctccgtacacccagaaagctaacacctagaacaataactgcctgtaagcatgccgaactctctaaactgatgatgaaatacgtcactaatgaagggaccagtggtcccaggggagctgaacacctgacgctgcgcccctaacaacgggtaagaagaaacaagggccgctgcgcaagcagcggcaggacacccggcgccaagggggcgcggcctggagcgccggggcacgaggccctgcttcaagctgagggcccggggagaagccggtacctctccacctcctgcagctcccgttcctccggctcccagtcggaatcggggtccggctcccggccaatagggcctgggcccgccaccccccgggtcgcgaacccacagcgagtgacggcggcgcaaacgcgcccgcccagcaagagactcagggtaaccgccatgtcgacgcaaaccagccttcagcagtcggctacgaaacagcagcggaagtagccgggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292159 - DNA, 880 bp, Homo sapiens
ataccctctatacgttccggcacgaggcggcctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292160 - DNA, 888 bp, Homo sapiens
cccacgcgtccgcggacgcgtgggtcgacccacgcgtccctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292161 - DNA, 1118 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgagaaaaacaccaaaaaaaaccaggccataaatcggga

SEQ ID NO: 292162 - DNA, 1056 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctgtaagtgctgccttgaaccctgcctccgaccccgggatcctctagagacagcttcgggggcgctgtcccgagggaggggcgggggctggcctgaggtctgcagaggagcgggagctggaggccgggagacctagcccgggctgcgccctcctcccggcacgccctccccgccctcgcctgaggccccagcgtggcaccgcggagccaccttacagcctccaggaaaagttaggcgctctttgaccctgggctccactagcttcagcactgccgaacttcctgccccagtccggcaggggccgaccttgcccagtggctaaaccacagaagccttggggagcccggctccttctcccaactttacctgaataatacagtaaccgttatcgctttctgagcactcaccatgtgccagggactgtgctaaatggttgcctgcgttacctaatttaatctttaggagagaggtactggacaatgaaacaggttcagaaaggtttggtaactgcttaagacaacactctgggtaagtagatttgaacttgggctggaagcccttttgccggatttatgcaggccaggttcctgtggcaaagataagctcatgggaaggaggtggaggccgaggaggacagttcagtgtggttgctaaaaaggaggctttgagggtaagagatccctggagtgaaggtgagaat

SEQ ID NO: 292163 - DNA, 656 bp, Homo sapiens
gagctgctggccgagtaccaggacttgacgtatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgagaccctatgtgtgacatgagatacactggtatgaggaaggactggacttctcttctaagagccttcaatcatcctaggaataagcagcatatcgagcagaggccagcgggaagtcaagccgcacccacgctggctgtccccgtgggagggtgtgaggatgaaggggcagcaggaggtgtgggactcgcctgtatcctgattggggtggtggttagatgagtctctgcatgcatcaaaatgtaaagaaccgtacatcagtaaagtctattttactgcatga

SEQ ID NO: 292164 - DNA, 966 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctgacttgacgttcctgacgaagcaggagatcctcctgtaagtgctgccttgaaccctgcctccgaccccgggatcctctagagacagcttcgggggcgctgtcccgagggaggggcgggggctggcctgaggtctgcagaggagcgggagctggaggccgggagacctagcccgggctgcgccctcctcccggcacgccctccccgccctcgcctgaggccccagcgtggcaccgcggagccaccttacagcctccaggaaaagttaggcgctctttgaccctgggctccactagcttcagcactgccgaacttcctgccccagtccggcaggggccgaccttgcccagtggctaaaccacagaagccttggggagcccggctccttctcccaactttacctgaataatacagtaaccgttatcgctttctgagcactcaccatgtgccagggactgtgctaaatggttgcctgcgttacctaatttaatctttaggagagaggtactggacaatgaaacaggttcagaaaggtttggtaactgcttaagacaacactctgggtaagtagatttgaacttgggctggaagcccttttgccggatttatgcaggccaggttcctgtggcaaagataagctcatgggaaggaggtggaggccgaggaggacagttcagtgtggttgctaaaaaggaggctttgagggtaagagatccctggagtgaaggtgagaat

SEQ ID NO: 292165 - DNA, 416 bp, Homo sapiens
gctgattctagaggacccccgtcgaccgagtccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaactcggtcagaggtgggaactcggtcagaggtgggaactcggtcagaggtgggaactcggtcagaggtg

SEQ ID NO: 292166 - DNA, 992 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctgacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292167 - DNA, 1621 bp, Homo sapiens
cgtatctgctccatggcttcccacgtcagggtcctgggcggggcaccaggcgcctccatttgcctccgaattttctggaatcggattgcttgtttctgtcgtttcagggtgctgggggaagagaaccaatggcagaagccatgcgtggaagcagaatggatgtttgaagagcctcaggctaaatcatggagcgcccagccctcttctctttgatcgcaagggcaaccgggccatgttgccggcttagagctgctccgtacacccagaaagctaacacctagaacaataactgcctgtaagcatgccgaactctctaaactgatgatgaaatacgtcactaatgaagggaccagtggtcccaggggagctgaacacctgacgctgcgcccctaacaacgggtaagaagaaacaagggccgctgcgcaagcagcggcaggacacccggcgccaagggggcgcggcctggagcgccggggcacgaggccctgcttcaagctgagggcccggggagaagccggtacctctccacctcctgcagctcccgttcctccggctcccagtcggaatcggggtccggctcccggccaatagggcctgggcccgccaccccccgggtcgcgaacccacagcgagtgacggcggcgcaaacgcgcccgcccagcaagagactcagggtaaccgccatgtcgacgcaaaccagccttcagcagtcggctacgaaacagcagcggaagtagccgggacttgacgttcctgacgaagcaggagatcctcctttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292168 - DNA, 1915 bp, Homo sapiens
cgtatctgctccatggcttcccacgtcagggtcctgggcggggcaccaggcgcctccatttgcctccgaattttctggaatcggattgcttgtttctgtcgtttcagggtgctgggggaagagaaccaatggcagaagccatgcgtggaagcagaatggatgtttgaagagcctcaggctaaatcatggagcgcccagccctcttctctttgatcgcaagggcaaccgggccatgttgccggcttagagctgctccgtacacccagaaagctaacacctagaacaataactgcctgtaagcatgccgaactctctaaactgatgatgaaatacgtcactaatgaagggaccagtggtcccaggggagctgaacacctgacgctgcgcccctaacaacgggtaagaagaaacaagggccgctgcgcaagcagcggcaggacacccggcgccaagggggcgcggcctggagcgccggggcacgaggccctgcttcaagctgagggcccggggagaagccggtacctctccacctcctgcagctcccgttcctccggctcccagtcggaatcggggtccggctcccggccaatagggcctgggcccgccaccccccgggtcgcgaacccacagcgagtgacggcggcgcaaacgcgcccgcccagcaagagactcagggtaaccgccatgtcgacgcaaaccagccttcagcagtcggctacgaaacagcagcggaagtagccgggacttgacgttcctgacgaagcaggagatcctccttagagaaggggttcaccatgttgctcagactggtctcagacgcctgacctccaatgctccacccgccttggcctcccaaagtgctgggattacaggtgtgagccaccgtgcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttactgttgcctgatgactcggaagttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292169 - DNA, 1202 bp, Homo sapiens
gagctgttctagagtatcccaagatagccaagcagccgcccccggctaatttttgtatttttagtagagaaggggttcaccatgttgctcagactggtctcagacgcctgacctccaatgctccacccgccttggcctcccaaagtgctgggattacaggtgtgagccaccgtgcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttactgttgcctgatgactcggaagttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292170 - DNA, 1008 bp, Homo sapiens
cccacgcgtccgcggacgcgtgggtcgacccacgcgtccctcgaggcgagttggcggagctgtgcgcgcggcggggcgatggggggctcgggcagtcgcctgtccaaggagctgctggccgagtaccaggacttgacgttcctgacgaagcaggagatcctcctttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292171 - DNA, 1087 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctgacttgacgttcctgacgaagcaggagatcctccttagagaaggggttcaccatgttgctcagactggtctcagacgcctgacctccaatgctccacccgccttggcctcccaaagtgctgggattacagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292172 - DNA, 1497 bp, Homo sapiens
cgtatctgctccatggcttcccacgtcagggtcctgggcggggcaccaggcgcctccatttgcctccgaattttctggaatcggattgcttgtttctgtcgtttcagggtgctgggggaagagaaccaatggcagaagccatgcgtggaagcagaatggatgtttgaagagcctcaggctaaatcatggagcgcccagccctcttctctttgatcgcaagggcaaccgggccatgttgccggcttagagctgctccgtacacccagaaagctaacacctagaacaataactgcctgtaagcatgccgaactctctaaactgatgatgaaatacgtcactaatgaagggaccagtggtcccaggggagctgaacacctgacgctgcgcccctaacaacgggtaagaagaaacaagggccgctgcgcaagcagcggcaggacacccggcgccaagggggcgcggcctggagcgccggggcacgaggccctgcttcaagctgagggcccggggagaagccggtacctctccacctcctgcagctcccgttcctccggctcccagtcggaatcggggtccggctcccggccaatagggcctgggcccgccaccccccgggtcgcgaacccacagcgagtgacggcggcgcaaacgcgcccgcccagcaagagactcagggtaaccgccatgtcgacgcaaaccagccttcagcagtcggctacgaaacagcagcggaagtagccgggacttgacgttcctgacgaagcaggagatcctcctgatgacttcttcttccctctctgcccacacttacgttgtatgtgacctgcctttgggttaaacacttgactcccaggaagccatctcagtcccttccccagctgggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292173 - DNA, 1392 bp, Homo sapiens
cgtatctgctccatggcttcccacgtcagggtcctgggcggggcaccaggcgcctccatttgcctccgaattttctggaatcggattgcttgtttctgtcgtttcagggtgctgggggaagagaaccaatggcagaagccatgcgtggaagcagaatggatgtttgaagagcctcaggctaaatcatggagcgcccagccctcttctctttgatcgcaagggcaaccgggccatgttgccggcttagagctgctccgtacacccagaaagctaacacctagaacaataactgcctgtaagcatgccgaactctctaaactgatgatgaaatacgtcactaatgaagggaccagtggtcccaggggagctgaacacctgacgctgcgcccctaacaacgggtaagaagaaacaagggccgctgcgcaagcagcggcaggacacccggcgccaagggggcgcggcctggagcgccggggcacgaggccctgcttcaagctgagggcccggggagaagccggtacctctccacctcctgcagctcccgttcctccggctcccagtcggaatcggggtccggctcccggccaatagggcctgggcccgccaccccccgggtcgcgaacccacagcgagtgacggcggcgcaaacgcgcccgcccagcaagagactcagggtaaccgccatgtcgacgcaaaccagccttcagcagtcggctacgaaacagcagcggaagtagccgggacttgacgttcctgacgaagcaggagatcctcctgccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292174 - DNA, 1112 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgaaacaaaaaacaacaaccaacactaaaaagg

SEQ ID NO: 292175 - DNA, 1124 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgaaacacaccacacaaaaaaaatcgggggactaaaacggggcga

SEQ ID NO: 292176 - DNA, 1362 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgagaccctatgtgtgacatgagatacactggtatgaggaaggactggacttctcttctaagagccttcaatcatcctaggaataagcagcatatcgagcagaggccagcgggaagtcaagccgcacccacgctggctgtccccgtgggagggtgtgaggatgaaggggcagcaggaggtgtgggactcgcctgtatcctgattggggtggtggttagatgagtctctgcatgcatcaaaatgtaaagaaccgtacatcagtaaagtctattttactgcatga

SEQ ID NO: 292177 - DNA, 1154 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacgtgagcagctgagcaggcctgggagcgggagggagcagttggggctctggcctgaaactctccctttcccagatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292178 - DNA, 1032 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctatggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292179 - DNA, 1080 bp, Homo sapiens
cccacgcgtccgcggacgcgtgggtcgacccacgcgtccctcgaggcgagttggcggagctgtgcgcgcggcggggcgatggggggctcgggcagtcgcctgtccaaggagctgctggccgagtaccaggacttgacgttcctgacgaagcaggagatcctcctttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacgtgagcagctgagcaggcctgggagcgggagggagcagttggggctctggcctgaaactctccctttcccagatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292180 - DNA, 771 bp, Homo sapiens
gcggggccgtgagtcccgggctccgccccggagcgtcgggcccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaactcgatttccagatttatggggatactcatagagc

SEQ ID NO: 292181 - DNA, 960 bp, Homo sapiens
gagctgttctagagtatcccaagatagccaagcagccgcccccggctaatttttgtatttttagtagagaaggggttcaccatgttgctcagactggtctcagacgcctgacctccaatgctccacccgccttggcctcccaaagtgctgggattacaggtgtgagccaccgtgcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttactgttgcctgatgactcggaagttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggtgcaagcgcttcaccctcctttgacacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttga

SEQ ID NO: 292182 - DNA, 956 bp, Homo sapiens
cccacgcgtccgcggacgcgtgggtcgacccacgcgtccctcgaggcgagttggcggagctgtgcgcgcggcggggcgatggggggctcgggcagtcgcctgtccaaggagctgctggccgagtaccaggacttgacgttcctgacgaagcaggagatcctcctttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagtccttaaagattggcgtgaagcagccaggtgtgtctggacctgttcaagaccttttagtgaggtgggcaggcagctgtggccaggggggcatggcactgagtggggggaggccacccgggggggcccgtgaagccccaccgggggagcgggggcaccacgaagggggggcaaaacacacaaggaaaaaaacagaaaaaacacag

SEQ ID NO: 292183 - DNA, 1437 bp, Homo sapiens
cgtatctgctccatggcttcccacgtcagggtcctgggcggggcaccaggcgcctccatttgcctccgaattttctggaatcggattgcttgtttctgtcgtttcagggtgctgggggaagagaaccaatggcagaagccatgcgtggaagcagaatggatgtttgaagagcctcaggctaaatcatggagcgcccagccctcttctctttgatcgcaagggcaaccgggccatgttgccggcttagagctgctccgtacacccagaaagctaacacctagaacaataactgcctgtaagcatgccgaactctctaaactgatgatgaaatacgtcactaatgaagggaccagtggtcccaggggagctgaacacctgacgctgcgcccctaacaacgggtaagaagaaacaagggccgctgcgcaagcagcggcaggacacccggcgccaagggggcgcggcctggagcgccggggcacgaggccctgcttcaagctgagggcccggggagaagccggtacctctccacctcctgcagctcccgttcctccggctcccagtcggaatcggggtccggctcccggccaatagggcctgggcccgccaccccccgggtcgcgaacccacagcgagtgacggcggcgcaaacgcgcccgcccagcaagagactcagggtaaccgccatgtcgacgcaaaccagccttcagcagtcggctacgaaacagcagcggaagtagccgggacttgacgttcctgacgaagcaggagatcctcctttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggtgcaagcgcttcaccctcctttgacacctctcccaccactccctccctgctagaccccctaactccatctgccactagctttgggatcatggggtcactggtccccactctggtcatttttctgcttagttctgattttctaggggcaaggactttaccaaaatcacctggcagaattatctagaatggtgcttttcaaatggggattctagaacataatcttggaagttcacaagaagttttgtcccttaagaggagttgaggtacctcattagagtttgaggaaccgtgttctagaggctgattgccactccgtaaggctgctgccaaatttctgtgcaaagggcctggcccggtgcctgtaacacaatagctgttcaagtaaatatttgtgttttaaaataaccagcccatctcgttccctttgttt

SEQ ID NO: 292184 - DNA, 1018 bp, Homo sapiens
gagctgttctagagtatcccaagatagccaagcagccgcccccggctaatttttgtatttttagtagagaaggggttcaccatgttgctcagactggtctcagacgcctgacctccaatgctccacccgccttggcctcccaaagtgctgggattacaggtgtgagccaccgtgcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttactgttgcctgatgactcggaagttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggtgcaagcgcttcaccctcctttgacacctctcccaccactccctccctgctagaccccctaactccatctgccactagctttgggatcatggggtcactggtccccactctggtcatttttctgcttagttctgattttctaggggcaaggactttaccaaaatcacctggcagaattatctagaatggtgcttttcaaatggggattctagaacataatcttggaagttcacaagaagttttgtcccttaagaggagttgaggtacctcattagagtttgaggaaccgtgttctagaggctgattgccactccgtaaggctgctgccaaatttctgtgcaaagggcctggcccggtgcctgtaacacaatagctgttcaagtaaatatttgtgttttaaaataaccagcccatctcgttccctttgttt

SEQ ID NO: 292185 - DNA, 927 bp, Homo sapiens
gagctgttctagagtatcccaagatagccaagcagccgcccccggctaatttttgtatttttagtagagaaggggttcaccatgttgctcagactggtctcagacgcctgacctccaatgctccacccgccttggcctcccaaagtgctgggattacaggtgtgagccaccgtgcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttactgttgcctgatgactcggaagttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggtgcaagcgcttcaccctcctttgacacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccccctgagaagggcccacaaagggagggaaggcacgtgggttgctatctcgtc

SEQ ID NO: 292186 - DNA, 368 bp, Homo sapiens
cccctccccgggccccgcctccagctcgcctaggaccgcttggagccggcagctcgcctgccaaacccggctgggaacgcctggcagcttttaggagggggcgggcccgggggtggtggccccaggagcggttgccgcggggaccgggcagtgacgcggcccaagggcggaagtgagaaagttgtctgcgtctctcgaggcgagttggcggagctgtgcgcgcggcggggcgatggggggctcgggcagtcgcctgtccaaggagctgctggccgagtaccaggtgcgcgggacgcctggccctggggagctcgcgtgcgggcctcttctcgggagcagggtccgggagctggctgcggggcggccgc

SEQ ID NO: 292187 - DNA, 3542 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcacccctggcccactctagttatgacaaccaaaaatgtctctatacattgccagatttctcctagggggcaaaatcgcctccatttgagactacaactctgagttccgtagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctacagaacagtgactgaggttcctttttttttttttttttttttttttttcaaatttccatgtattttctgccatttttcagggtctaagattggtcatacattcccaatttactctcagttccagtcaagctggttgctctgaaagtaacccagcttgttgctctaaaatacctcagtagcctgagtgttatactagagatctaaagggttaacaggatagggtggaaaggttagagactcctagaaatctctggtcaccgtgatcttcggcctcattctaatacctgttctttggacagtctttttcctttggtgctctcttgcctttagctaccttctctaatatgtatgctaccatcactaataaagtgatgggaatgggtttgagagtcgtaatttatattaaaaagttgttggacttttaaatacattttttcaaataaaaaattaagcaaaat

SEQ ID NO: 292188 - DNA, 1820 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaa

SEQ ID NO: 292189 - DNA, 3761 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccggtgagtctccccaccccccatcctaacccaaagagcagtcagttactgtgtgctgtgaggtagccacaccatctaggatctgccatctaaaaaagcacacttcttgcctccctctgtgtcaggagcttctatggtcaggcagctgtatatgtggaacaaaggggactgggtgatggaagaagtgaatagtcctagctattacctcctgttcctgtccattctgagctgggtggggtttgtaggtggagctgcatacctgtcagttttccccattatttcatcatcagtcagaggtgactttgacatgtcctttctttgtccagtgttcactctgcaggccactgccctcactactctggttcatgtcttctgtgtgcttttgttgttccagctttgcctttcatgccctagtgatttccctgttaaaatgccacatcccctcttcccaccaggcccttagcttttcagtggttttgaagactcttttcccttcctccgtgctgactgggaggaggccttaagacatgactccttatcttctccaagcagaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcacccctggcccactctagttatgacaaccaaaaatgtctctatacattgccagatttctcctagggggcaaaatcgcctccatttgagaaccacaactctaaagtcaagatatttttctctgaagtgatttctgcttggcacgctaccctcatcatcttactcatcttaagcccgagccatggatcaactaggagcccatataaatgaggctcagtagggctgcacataatctccaaacaattctttattcagtgttttgcttgtgtttgcatgttgctatgatggacaggtccccctcctccattcttgccctctggagaagtggttcctgcagtgtagagatatgaacagggtatggtaggattggggaaaggggagagagaagcagtagatacactccttatcctccccaaattttaagctctatttctgtgccctagtcctagacacacattagactcagggagttttgtctgaagaccaggtcccactgccccctggctgaagagtctgctttaaatgggaaaacaacgtaggagcaggggtttttaggcactttcagtattctcaggtgttcttcgttctggcccttccagggtaattaggaaggcagaacaagacagatgagctcctgcctgctctgagacaagaagggtggggtctcattagctttgcaacaggaaacatcctgttttatggtagtggggtcaggaatgtaggaactggtatccattctgccaattccaccacccattcagtttgcttatccctatcctgttaaccctttagatctctagtataacactcaggctactgaggtattttagagcaacaagctgggttactttcagagcaaccagcttgactggaactgagagtaaattgggaatgtatgaccaatcttagaccctgaaaaatggcagaaaatacatggaaatttgaaaaa

SEQ ID NO: 292190 - DNA, 1951 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagatgatctgtactggacacacgtggagatatggccatgccacgcatgtgcaaacagaggtgtacacacaggagtgcagtgatacaggacacagataaacagaatgtacacagccttcaggaaggatctcaagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaa

SEQ ID NO: 292191 - DNA, 1490 bp, Homo sapiens
tgctaatttctgccactatccttggtcctcgcccatcctcttaactctaagtgcttctagcccccttcctctcccttggtaccaccagccactgctccttaaccccttggtgtccttttggttctgttccttttttttagagtcaaactgaggttcatagtgtttgggaatgagtgttggtgtacaggtctagggcctctcagggaggactgggaagatataggctcatcaggaggtttctcaaggattgggggagggggagatttctcactgatctttctttttactttcttctaatccagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaa

SEQ ID NO: 292192 - DNA, 2039 bp, Homo sapiens
tgctaatttctgccactatccttggtcctcgcccatcctcttaactctaagtgcttctagcccccttcctctcccttggtaccaccagccactgctccttaaccccttggtgtccttttggttctgttccttttttttagagtcaaactgaggttcatagtgtttgggaatgagtgttggtgtacaggtctagggcctctcagggaggactgggaagatataggctcatcaggaggtttctcaaggattgggggagggggagatttctcactgatctttctttttactttcttctaatccagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccggtgagtctccccaccccccatcctaacccaaagagcagtcagttactgtgtgctgtgaggtagccacaccatctaggatctgccatctaaaaaagcacacttcttgcctccctctgtgtcaggagcttctatggtcaggcagctgtatatgtggaacaaaggggactgggtgatggaagaagtgaatagtcctagctattacctcctgttcctgtccattctgagctgggtggggtttgtaggtggagctgcatacctgtcagttttccccattatttcatcatcagtcagaggtgactttgacatgtcctttctttgtccagtgttcactctgcaggccactgccctcactactctggttcatgtcttctgtgtgcttttgttgttccagctttgcctttcatgccctagtgatttccctgttaaaatgccacatcccctcttcccaccaggcccttagcttttcagtggttttgaagactcttttcccttcctccgtgctgactgggaggaggccttaagacatgactccttatcttctccaagcagaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaa

SEQ ID NO: 292193 - DNA, 1801 bp, Homo sapiens
acacttagaggatccccagagtacgatatgtacacagccttcaggagtggatctcaaggtctcgggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccggtgagtctccccaccccccatcctaacccaaagagcagtcagttactgtgtgctgtgaggtagccacaccatctaggatctgccatctaaaaaagcacacttcttgcctccctctgtgtcaggagcttctatggtcaggcagctgtatatgtggaacaaaggggactgggtgatggaagaagtgaatagtcctagctattacctcctgttcctgtccattctgagctgggtggggtttgtaggtggagctgcatacctgtcagttttccccattatttcatcatcagtcagaggtgactttgacatgtcctttctttgtccagtgttcactctgcaggccactgccctcactactctggttcatgtcttctgtgtgcttttgttgttccagctttgcctttcatgccctagtgatttccctgttaaaatgccacatcccctcttcccaccaggcccttagcttttcagtggttttgaagactcttttcccttcctccgtgctgactgggaggaggccttaagacatgactccttatcttctccaagcagaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaa

SEQ ID NO: 292194 - DNA, 1777 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagatgatctgtactggacacacgtggagatatggccatgccacgcatgtgcaaacagaggtgtacacacaggagtgcagtgatacaggacacagataaacagaatgtacacagccttcaggaaggatctcaagggttccgagtctgaggaagacataaccttgtgcctgcctgcccacctctctctctggtcctgttcatctctcaggctctgagacactgaccttcactgctcagttaaaggttccagggattccactttgtctggacccatccaaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaa

SEQ ID NO: 292195 - DNA, 1997 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctcaatagcctcttggggaatcctctgaacagctagcg

SEQ ID NO: 292196 - DNA, 2429 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaaaaaaaaaaaaaaaagaaaaaaagcaaaaaaaaaaaaaaaacaaaaaaaacaaaaaaaaaaaaaagacggggggcggcccgcccaataaataattctactcctcaaggagaggggcccaacttatcgacgccacaccgcagctgttttagaacaagaggggccccccaattagggcaggtcattaattacaccagcgacgggtagagcaggcgcgttaatcacaccagctcctttctagcgtggaaaaacacgtcgtgccaaccacctgcacaaacaccacttccacgacagaagacaaccccaccctacacctccgagcgggggacgggacaccaaccaactcgggcgaacaaaccacacgaccctgaccagagaaacggatatgtaaccgccccctccaggagcgagcagcaaaaaacaacacctatcacaaccccgggtaaaccagggggtcggcaaccacacacacgccagcaaaatacacgccctgcacggcgctgcacaacaagaccttggtgcaacccacagcgaccctagtcaccaccccagcaagccaacatattactaccaccgagagcacctcgtgcaagatcaacagccgcgacacct

SEQ ID NO: 292197 - DNA, 1686 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccacagtatcacattaaccggggccggctcgta

SEQ ID NO: 292198 - DNA, 2405 bp, Homo sapiens
cctggctttgtgcattgggttctggtgcctgactggacacatttttccagttacaggccgaatggtctcaatgtagctgaagaactgtgcccactgatcagtattacgtattgcaaatgcaggaggtggctgtatctgacagacccaggccttccagctccgacagatccagttctgggatgggcatcctccagaaaagaaaggaactgtactggctactcacagggtccctcatagcttcctagaaagaaaccacttgtcagtcttcatgctacagcaacttctttgtggcccatggcctttccttgcttagatactccacataccgttctccccgacagggtgcggcggccttgaggggctgcagaggcaccctcccacgtcccgcgcagtgcagtgcctccgcaagtccagaggggagcagtgcgcccggcatccgagccggacaggagttacgtaatcgcgtcagccgacgcattacgacactcagacggccccacctctgccggctcgtactcggctcccccacctcgccgcagagctagcccgggaagcccacactggcggccacggagcagagtccctcacccccaccagctgtagctgaacgtctggatggtggagaagagcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagaggagtgaagctggaaccatcagggaacatgagtgaattttggcacaaactgggctgctgtgtggtagagaaaccccagccgaagaagaagagaagacggattgaccggaccatgattggggaaccaatgaattttgttcacctgactcacattggctcaggggagatgggggccggagatggacttgccatgacaggtgcagttcaggagcagatgagatccaagggaaaccgagataggccatggagcaattctaggggcttatagctccaataatggaatggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaatcagtctagggtgccaaagcatcagggttcccggcctgcaagaaagggagattcctgttcatgttaaagtgtcatatttatgaaactgccctttttggaatctttgaggttgtctgtactataggactggggaaatgcaagtgagtctaagaagaaacccagatgtgtcctaccctggctggcagtagtgagaagggaggaagttcttccttggacactagtactattggaaagttccttatgtctggttcactgatgaagcttgaggatagaattggtgaggagggaggggagaacaggtcacagctggaggggagcctgggccctatagggtgtgaggcagagcagagtggcagataggacatgtggacggtggggaaaatattcctcatgggacagaagatacctggcacatgtacccacaacctgtacacagatgatctgtactggacacacgtggagatatggccatgccacgcatgtgcaaacagaggtgtacacacaggagtgcagtgatacaggacacagataaacagaatgtacacagccttcaggaaggatctcaaggtcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccaggaaaagagcccttgggggctcagacagaggagtgaagctggaaccatcaggcaccatgagtgactcctggcacaaactgggctgctgtgtgggcagagaaccccagccggtgacgtctccccacccccatctaaccca

SEQ ID NO: 292199 - DNA, 1379 bp, Homo sapiens
acagggtcttgtcctgtcacccaggctggagtgcaggggtgcaaacatggctcactgtagccgcaactcttgggctcaagtgatcctcctgcctcagcctccccagtagctgggatgacaggcacatgctaccacaccctgctatctcgtttttttgtgtgtgttttttttgaggcggagtttcgctcttgttgcccaggctggagtgcagtggcgatctcggctcactgcaatctccggttcaagcgattctcctgcctcagcctcccaagtagctgggattacaggcatccgccaccacgcccagctaatcttttgtatttttagcagagatggggtttcaccatgttggccaggctggtctggaactcctgacctcaggtgatccgcccaccttggcctcccaaagtgctgggattacaggcgtgagccaccacgcccggcctatctcttgtttttaaatcagtctagggtgccaaagcatcagggttcccggcctgcaagaaagggagattcctgttcatgttaaagtgtcatatttatgaaactgccctttttggaatctttgaggttgtctgtactataggactggggaaatgcaagtgagtctaagaagaaacccagatgtgtcctaccctggctggcagtagtgagaagggaggaagttcttccttggacactagtactattggaaagttccttatgtctggttcactgatgaagcttgaggatagaattggtgaggagggaggggagaacaggtcacagctggaggggagcctgggccctatagggtgtgaggcagagcagagtggcagataggacatgtggacggtggggaaaatattcctcatgggacagaagatacctggcacatgtacccacaacctgtacacagatgatctgtactggacacacgtggagatatggccatgccacgcatgtgcaaacagaggtgtacacacaggagtgcagtgatacaggacacagataaacagaatgtacacagccttcaggaaggatctcaaggtcagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccaggaaaagagcccttgggggctcagacagaggagtgaagctggaaccatcaggcaccatgagtgactcctggcacaaactgggctgctgtgtgggcagagaaccccagccggtgacgtctccccacccccatctaaccca

SEQ ID NO: 292200 - DNA, 302 bp, Homo sapiens
cagcctcttccctggaaggcacaaagtagagttcttactgtaggatatgaagacttacgaaggtgtctcgcatctgtttttttacagacaggtgcagttcaggagcagatgagatccaagggaaaccgagataggccatggagcaattctaggggcttatagctccaataatggaatggtgagtgattagagaaacccatctaacacctcagcccccataacagcacaacctgataccctgactcagaaccctgatcttatgcaagaaagggaggtgtggccgggcatggtggcttatgcct

SEQ ID NO: 292201 - DNA, 813 bp, Homo sapiens
aacctaggctagtacgaggacgagtgttaatcggccgaggccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaactggcccattctgtgtgcccagcctgggacccggtggggggaaggcc

SEQ ID NO: 292202 - DNA, 1154 bp, Homo sapiens
ggcgcttcttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagaaaaaacc

SEQ ID NO: 292203 - DNA, 1172 bp, Homo sapiens
aacctaggctagtacgaggacgagtgttaatcggccgaggccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagaaaaaacc

SEQ ID NO: 292204 - DNA, 1016 bp, Homo sapiens
aacctaggctagtacgaggacgagtgttaatcggccgaggccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagaaaaaacc

SEQ ID NO: 292205 - DNA, 1017 bp, Homo sapiens
ggcgcttcttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgtcaggcccaagcagaccccgggctccaccccagccccgcccaggctgctgccagtgcacacttttacaaatttaatataaagcaagtccagtcttaaaaagaaaaaacc

SEQ ID NO: 292206 - DNA, 1150 bp, Homo sapiens
aacctaggctagtacgaggacgagtgttaatcggccgaggccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatgccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagaaaaaacc

SEQ ID NO: 292207 - DNA, 1013 bp, Homo sapiens
aacctaggctagtacgaggacgagtgttaatcggccgaggccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatgccctggggtctgtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgtcaggcccaagcagaccccgggctccaccccagccccgcccaggctgctgccagtgcacacttttacaaatttaatataaagcaagtccagtcttaaaaagaaaaaacc

SEQ ID NO: 292208 - DNA, 1156 bp, Homo sapiens
cttcattacacaggagtgacgcctgaagctgaagcaattaacacaatgttacacgaccgaaagctgaggcaaggggccagtgtggagccatgataagaaactcagactcacagggcctaagtaactcatccgaggtcacagagcaaatgagagagatgggtctcccagcaaatctgcaggcctcagcccagagctgtgccacactacagcccatgcttttaatcactctgccagcactattccctgacatgcagggtgatggactgctacacagctgctgattaattagtgaatgctgctgctatttgccctccctcccccaagataaacaaaggctgaccatgagaaagataccagtacacccccaggaagccagccgattctctggtgatgagtgatgctgggaacagcagactggacatctatgggcatctgatggccactttaaagcactcaaggagaggtgaagaaaaaaaaaataggctcccctccaatgcaatttttaaaccactgattcaccatgcaatgcagtgttaaagtcaaaagaaccttagccactactgtatttgcaaaaattctgtactttgttttaaaaagcaccatttgttagcccaacattccccatggagccagttgggagatgacatcttgacaagttggactctttcgggacaaagaatacaagctgcatcagttctatttcttccccagccagaatacacaggactagccatcaaggggtagaagcaaaaatggctcctctcctcttaaacctagtgatatggtttggatatttgtcccctccaaatctcatattgatatttgatctcccacgttggaggtggggcctagtgggaggtgtttgggtcataggggcggatccctcacgaaaggcttgctgtcctccttcgaggtaatgagtgagttcacgtgagaactggttgtttaaaagagcatggcacctcctcgtctcttgcttcctctctcaccatgtgacacaccagctccccttccacttgcacaatgtttggaagctcctggaagccctcaccagaagcagatgctgacgccatgcttcttgtacagctggtggaatcataatccaaataaacttttttttctttataaactgcccagtttcaagtattcttttatg

SEQ ID NO: 292209 - DNA, 1879 bp, Homo sapiens
  misc_feature (697)..(697): n is a, c, g, or t
cctgagatagagtctggctctgtcgccaaggctggagtgcagtggtgtgatctcggctcactgcaatctctgcctcctgggttcaagcaattctcctgcctcagcctcccaaggagctgggactacaggcatgcaccgccctgcctggctaatttttttgtatttttttttagtagaaacggagtttcaccgtgttgcccaggctggtctggaactcctgagctcaggcaatccacccgccttggcctcccaaagtgctaagattacagttgtgagccactgcacctggccaaatactcggtattcttgaaagcattctattagtacaaggcatttttactttcttccaccctgctggctactccctcagagacggagagtccctcaaagtcctcccacttctccctatccttccctgtcctagaagcacgaaacctacctctccgggctgccctcgcccttgtgaacactgacttctctgaccaatgcctgtggtcctggtgacctgggctgtgccacattccacactgttctatcgtgcagttgcccacccaatatggtgaacaacagcccttggagagggattgattaggacaaacgccctcattttgcagatgaaggaatgaaggttcaaaggaattctttacatcattcctgtcttggggaggaaatcttgcacttacatttgactcttctntgcatttggtataaaaatagctatcatttactgagaattatctaggggtctaaccaatgccttttctgatgactttattcaattctaacaacgccaggaaatatactgcattttacagataagaaactcagactcacagggcctaagtaactcatccgaggtcacagagcaaatgagagagatgggtctcccagcaaatctgcaggcctcagcccagagctgtgccacactacagcccatgcttttaatcactctgccagcactattccctgacatgcagggtgatggactgctacacagctgctgattaattagtgaatgctgctgctatttgccctccctcccccaagataaacaaaggctgaccatgagaaagataccagtacacccccaggaagccagccgattctctggtgatgagtgatgctgggaacagcagactggacatctatgggcatctgatggccactttaaagcactcaaggagaggtgaagaaaaaaaaaataggctcccctccaatgcaatttttaaaccactgattcaccatgcaatgcagtgttaaagtcaaaagaaccttagccactactgtatttgcaaaaattctgtactttgttttaaaaagcaccatttgttagcccaacattccccatggagccagttgggagatgacatcttgacaagttggactctttcgggacaaagaatacaagctgcatcagttctatttcttccccagccagaatacacaggactagccatcaaggggtagaagcaaaaatggctcctctcctcttaaacctagtgatatggtttggatatttgtcccctccaaatctcatattgatatttgatctcccacgttggaggtggggcctagtgggaggtgtttgggtcataggggcggatccctcacgaaaggcttgctgtcctccttcgaggtaatgagtgagttcacgtgagaactggttgtttaaaagagcatggcacctcctcgtctcttgcttcctctctcaccatgtgacacaccagctccccttccacttgcacaatgtttggaagctcctggaagccctcaccagaagcagatgctgacgccatgcttcttgtacagctggtggaatcataatccaaataaacttttttttctttataaactgcccagtttcaagtattcttttatg

SEQ ID NO: 292210 - DNA, 1721 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaatggaaagtacacctaacacaatcaaagcatttctctccaaacactgtgctgaccacccaaacaattgggatgatcacctatcagctgtttcatttgccttcaatgtaactcacttggaacctactaaaaatacaccatattttcaaatgtttagtcgaaatccttatatgcctgagacttcagatagtcttcatgaagtggatggtgataatacaagtatgtttgccaaaattctagatgcaattaaagaagctgataaaataatggagaataagacaacttcactgggccagatggagaacaacaatttggatgaactaaataaaagcaagatcattgttaaaaagaaacccaaacaattaaatccatttcatttaaaagtgggtcatgaagttttaagacaaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatccagtgaacaagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292211 - DNA, 1644 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaatggaaagtacacctaacacaatcaaagcatttctctccaaacactgtgctgaccacccaaacaattgggatgatcacctatcagctgtttcatttgccttcaatgtaactcacttggaacctactaaaaatacaccatattttcaaatgtttagtcgaaatccttatatgcctgagacttcagatagtcttcatgaagtggatggtgataatacaaatggagaacaacaatttggatgaactaaataaaagcaagatcattgttaaaaagaaacccaaacaattaaatccatttcatttaaaagtgggtcatgaagttttaagacaaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatccagtgaacaagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292212 - DNA, 1066 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292213 - DNA, 1527 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaaggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaatggaaagtacacctaacacaatcaaagcatttctctccaaacactgtgctgaccacccaaacaattgggatgatcacctatcagctgtttcatttgccttcaatgtaactcacttggaacctactaaaaatacaccatattttcaaatgtttagtcgaaatccttatatgcctgagacttcagatagtcttcatgaagtggatggtgataatacaagtatgtttgccaaaattctagatgcaattaaagaagctgataaaataatggagaataagacaacttcactgggccagatggagaacaacaatttggatgaactaaataaaagcaagatcattgttaaaaagaaacccaaacaattaaatccatttcatttaaaagtgggtcatgaagttttaagacaaaggaaaaattggtggaaggatggtcgttttcagtctgaatgggttggtccttgtgtcatagactatattacagaaagtggatgtgctgtcctgagagacaacactggggttagactgaaaagacctatcaaaatgtcccaccttaagccctacataagagaatccagtgaacaagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292214 - DNA, 1258 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagaaaaaaagctgttttatgttggaaaagacagaaaacaaaatcgtttggtaattgtttcagaagaggaaaaaaagaaagtcttaagagaatgccatgaaaatgacagtggagctcatcatggtatatccaggaccctcactctggtagaatccaattattattggacatctgtgaccaatgatgtcaaacagtgggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagatcaatattgaactgtacagattgtttggcataaagcaaattgtaatttctcacacctctggaactgttaacccaatggaaagtacacctaacacaatcaaagcatttctctccaaacactgtgctgaccacccaaacaattgggatgatcacctatcagctgtttcatttgccttcaatgtaactcacttgaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292215 - DNA, 872 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaaggtatatgcttgtcagcattgccaagtggcaaaaaatacagttattgtagcaccgaaacagcaccttctcaaggtggaaaatccatggagtttagttactgttgatctgatggggccttttcatacaagcaacagaagtcatgtatatgctataatcatgacagatttgttcaccaaatggattgtgattttgcctctatgtgatgtttcagcatcagaagtttctaaagctattatcaatatatttttcttatatggacctcctcagaaaataataatggaccaaagagatgaattcattcaacagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292216 - DNA, 615 bp, Homo sapiens
ttccgcttccggcagcgcgagataaatcacgagaggaagcttaaatctgtcgtttgaatttaggaccacctcggttcacaatggtccgtagtggaaaaaatggtgaccttcatcttaaacagattgcatattacaaacgaactggtgaatatcattcaactacactgccaagtgagagaagtggcataagaagagcagcaaaaaaatttgtcttcaaagacctcctcagaaaataataatggaccaaagagatgaattcattcaacagaaagtctttatctcttgcaaggttcagtagtggcagatcatgactacattggattgcctgaaattccgattggagcatatcaagcaaatattctggtggaagatgcaactattggtatagtcgataatgaattactgacatcaagcaaggatcgtgaactattagaatatagaaatacgaaaatctctccattgatagacgatcatagttctcttgaaaagcagactttcagtctgttggactcttcaaaccaggttcttgaatacttaagttagtaaataccaaaatttatttaaagtgcttgtttagaatataaattcttaatgatatcttattcattaaaaacg

SEQ ID NO: 292217 - DNA, 2347 bp, Homo sapiens
  misc_feature (2002)..(2002): n is a, c, g, or t
ggaggagaaaggggaaaggaagaaagaaggagagcaggagggcgaggagcggggggagcggggaggagggcgcggggaggaggcagcggggaggagcgtgcagggaggaggcagccgcgctgggaggagtctgcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacanggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctc

SEQ ID NO: 292218 - DNA, 2456 bp, Homo sapiens
  misc_feature (2111)..(2111): n is a, c, g, or t
ggaggagaaaggggaaaggaagaaagaaggagagcaggagggcgaggagcggggggagcggggaggagggcgcggggaggaggcagcggggaggagcgtgcagggaggaggcagccgcgctgggaggagtctgcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacanggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctc

SEQ ID NO: 292219 - DNA, 2495 bp, Homo sapiens
  misc_feature (2150)..(2150): n is a, c, g, or t
ggaggagaaaggggaaaggaagaaagaaggagagcaggagggcgaggagcggggggagcggggaggagggcgcggggaggaggcagcggggaggagcgtgcagggaggaggcagccgcgctgggaggagtctgcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatacttggccttttgcaagagcctgaagaagtttccttgaggtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacanggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctc

SEQ ID NO: 292220 - DNA, 750 bp, Homo sapiens
ggaggagaaaggggaaaggaagaaagaaggagagcaggagggcgaggagcggggggagcggggaggagggcgcggggaggaggcagcggggaggagcgtgcagggaggaggcagccgcgctgggaggagtctgcacactttcagtgccagggcattgtgggaagcagccatggtctaagccgggcgcctcacctgtcagccgcaccggctccagcgctcgcctctcgccctcgcttctccagcgctccttgctcgcaaggcgggggaggcggcggcccagccacgatgatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggaggtcagtacggtttcccaaaccatgggagaaagatga

SEQ ID NO: 292221 - DNA, 2039 bp, Homo sapiens
  misc_feature (1694)..(1694): n is a, c, g, or t
tgctggtattacaggcgtgagcaccacactggccaagcatttctcttatcagacattcactttatgatcaagcttaactttttctcagttgaaagttacttaattccagccccatatggatgtgtatacaaattatactcaaactttgattagaatgcaaagattttatatccatgtatccttttgacaacttgttttcaacaatggcaaataaataaaagaatgcagaagatttcacagtctgcggaaggctgtgacttaaagggaaaattgttctaatttattgttcgctttcagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacanggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctc

SEQ ID NO: 292222 - DNA, 609 bp, Homo sapiens
tagccacttacaaacaaatcaacatttttaaaaagaaaatgtaaagagatggggtcttgccaggtcttggccaggctggtcttgaactcccggactcaagcaactctcctgacttggcctcccaaagtgttggaattacaggcatgagccactgcagtagccctgattgttttaaatagaagaagatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtaagtgttgtccttgtcggttaggattagctacagtccccatctcagctcttacttcagttctgtctctggtcacatcccttctctctgtcacatctaaaatatgaattgaacttgaaccgaagatcaccttagt

SEQ ID NO: 292223 - DNA, 2353 bp, Homo sapiens
  misc_feature (2008)..(2008): n is a, c, g, or t
tagccacttacaaacaaatcaacatttttaaaaagaaaatgtaaagagatggggtcttgccaggtcttggccaggctggtcttgaactcccggactcaagcaactctcctgacttggcctcccaaagtgttggaattacaggcatgagccactgcagtagccctgattgttttaaatagaagaagatacatttcatattgctcttcagtcgacaagggaaattacggctacagaaatggtacatcactctccctgataaagagaggaagaagatcacccgggaaattgttcagattattctctcccgtggtcacaggacaagcagttttgttgactggaaggagctaaaacttgtttataaaaggtatgctagtttatatttttgctgtgcaatagaaaatcaggacaatgagctcttgacgctagagattgtgcatcgttacgtggagctgctggacaaatattttggaaatgtctgtgagctggatattatctttaattttgaaaaggcttatttcatcctggacgagtttataataggtggggaaattcaggaaacatccaagaaaattgctgtcaaagccattgaagactctgatatgttacaggagacaatggaagaatacatgaacaagcctacattttaactggaaatctacttgaagactccagcactacatgttatgaagctgtaaataagcaacgcctcccatccggttttttgatggagcctcaggcaccatgccaaaaataatttaaagggattctttgttaactaacaaagttaaagttgtttaacatatttataattactatgtgtctgtattattaaaaaaaattatgtgtctgtgttatactgtataggtacttgtagctctaaatgtttaaagtaactaccacctaacccaacagacaatatttgtaatgtattaactccatgttatgtttttaagctggtttagatacattagctgcaattttttttgcatttgacacaatattgtaataatccatgattttgaatgtaaagtatatatgatgtcattaatactttttctaaatgtttagttttctaaattgtataataattcaaaattatgttaatagtgcagagtttatatgtaatgctagacatttttcatacacttaatagtactgtaactgcaattcacatacaaaatgtctgattttaatgtgctgaattcatttattttttttagaattgggattatgaaaataaccaaagagtatagaacttaataagtgtttttgatgccttagaagctgctatcttgactgaggttttaatttatcttttaattgaatataagggacattccaataaggttttctatgaactatatatttattaaggtttatagagacctagagatacagcatctatgacttcctttattattctaaaatagtatgataagaattaatagcaataataattattgctactattttttaaaattcacgttccaagcactcttagatgctggaaatttcatttcaaatatgttttaatgtatctctaatgcatttgaagacttattacatggcttacttagagcatttaagattatcacagcctatatggtagattcctttccttcttttttcttttcttaccctttcctccccaaagaaaagatttgctgctgaccattattactgtaagtatatcacatttgtgcttcctggaatgaaaattctgtataaccaggtcctaacagtgatcagacatattacagggaaatagcttgtaggccgggagtggtggcttacacctgtaatcccagcactttgggaggccgaggcaggtggatcacttgaggtcaggagttcgagagcagcctggccaatatgatgaaaccccatctctactaaaaatacaaaaattaggccgggtacagtggctcatgcctataattccagcactttgggaggcagaggtgggcggatcacaaggtcaagagatcaagaccatcctcgccaacanggtgaaaccccacctctattaaaaatacaaaaattagccgggagtggtggtgcgtgcctgtagtcccagctacttgggaggctgaggcaggagaatcgcttgaacctgggaggcagaagttgcagtgagctgagattgtgccactgcactccagcctgggcgacagagcgagacttcgtctcaaacaaacaaaaaaattagccgggcatggtggcaggtgcctgtaatcccagctactcagggggctgaggcaggggaatggcttgaacccaggaggcagaggttgcagtgagccaaggtcataccagtgcactccaggcgggtgacagagcaagactgcgtctc

SEQ ID NO: 292224 - DNA, 412 bp, Homo sapiens
atcacccgggaaattgttcagattattctctcccgtggtcacaggacaagcagttttgttgactggaaggagctaaaacttgtttataaaaggtgtgagtaactttttgagagctcaatttctcagtcttactttggtttgttctaatcctgaacattttagattgctataccaattccatcatttactgaaatctttgaaggctggggcccagatatttgtaccaatagactaactagaaaagaactctcattttattgaaagaaattctaggtgccaggatggattctaggtaaataaactacaccttgatagtgcacgcatgcattcaagaaaagtggtatgaacacctgttacattcctggcattgttcttttttaatttgttggaggcggaatcttgctctgtcacc

SEQ ID NO: 292225 - DNA, 983 bp, Homo sapiens
gcttttccgtgctacctgcagaggggtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgccttgatctgtacttctacagagatcctgaagagattgaaaaagaagagcaggctgctgctgaaaaggcagtgaccaaggaggaatttccaggttgaatggactgctcccgtcctgagttcactgctattcagcctgaggttgcagactggtctgaagtgtacggtgcccctgtgcctattcagcaattccctactgaagactggagctctcagcctgccatggaagactggtctgcagctcccactgctcaggccactgaatgggtaggagcaaccactgactggtcttaagctgttcttgcataggct

SEQ ID NO: 292226 - DNA, 1508 bp, Homo sapiens
caaaagcaacccttcttgctccaggcatgtgcaggaggttttttggtttcagcattttgttgcatgctgactatgtcctttaccttctcttaaattatgtatcaattcatgctggtttattcacttcctgatgtctatatgaagaggctgtctgccaacatctttcatcactctgcctgcaactatgaaaaatttagttctaaaaaatgcaaccttgctaaattgagtactaataggattggttcaattatgttctatgtctgttccatattgacattgtgtgcatctttgccatgcaggctttttaggaattatcgcatctctaacttcccacgagtgtttatgaaaatgtttagatttaaagaactttattgctttagacagaataaggcatgcagttctaacagaaagatccatgaattccagaaatatcactgaaaattattgacatttaagattattttctgtttgttactatggttcacaattcaagaataactctggccaggtgcagtagctcacaccctgtaatcccagcactttgggaggctgaggtaggcagatcacttgagctcaagagttcaagaccagcctgggaaacatggcaaactcccaccattacaaaaaaatacaaaaattagttggtcatggtggtgttcacctatagtcccagtgacttgggaggctgggatgggaggatctcttgagcccaggagatgcaggcttgcagtgagccatgatcatgccactgtactgcagactgagtgaaacagcaagatcttgtctgaaaagaaaaaaaaaagtaaaagaaaaagaaaagaaaataactcccattgctaaagacatatatgcttatcaggttaagataaagtgaattttgttcttcccaatgacatttcaggatatttgttcacaggaaagaacatgttgggaattggtactggctagaaatttctgttgagtatttattaccccatggtaataatggtaaaccacagtttagaaagattttttttttgacagccacagcatgttccgaagagatgattggaagatggaagtggagggttaaataatgaaatgcagctaacatttcggaaagtttctaaaagttgtacaacatgccctacagctactctttaaatctccaaatcaaatgagtttcaggtggagcctctgggaggtgatgaggtcatgagagtggagcctcatgaatgggatgagcactcctacaaaaaggattccagagagctcgcttgctccttccacagtgtgaggacacagagggaaggctctgtctatgaatgagaaagtgggtccccaccagacattgaatctgccgcatcttgatactggacttccagtctccagaactgtgggcaataaatgtctgttgtttattacctgtccagtatctttggtattttgctatagcaacccaaatggactaagaaaacaccagaggccatacctaataaaaatattgacatcacaaaagttgtatcagg

SEQ ID NO: 292227 - DNA, 664 bp, Homo sapiens
aaacagcaagatcttgtctgaaaagaaaaaaaaaagtaaaagaaaaagaaaagaaaataactcccattgctaaagacatatatgcttatcaggttaagataaagtgaattttgttcttcccaatgacatttcaggatatttgttcacaggaaagaacatgttgggaattggtactggctagaaatttctgttgagtatttattaccccatggtaataatggtaaaccacagtttagaaagattttttttttgacagccacagcatgttccgaagagatgattggaagatggaagtggagggttaaataatgaaatgcagctaacatttcggaaagtttctaaaagttgtacaacatgccctacagctactctttaaatctccaaatcaaatgaggtgagttcatgtgaagtgcattttacagatgaagacatcaagggtcatcagggttaagtgatattctaaagtcacagatgaaactttggagctaagtagaggacactgccacattcaattaaaaattataaattgcaatgtttattcaaaattagttgaaacttagacacatgaaaagtcccaagaaactctggtccaattacaattattttttctaatagaagatctggagaggcctcagaaaaggacccatcttcatcttgccttcag

SEQ ID NO: 292228 - DNA, 1047 bp, Homo sapiens
cacaggctgaaggctggtgggaggaggggcagtctccaagagcccctgaaatcctcacacctgggttcctacctgctgtttccagctaggggaaggcgcaggagtgaggaatggagggagtggagggctctggccgatcaatgccttctctctctctctgcctctcagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292229 - DNA, 1004 bp, Homo sapiens
  misc_feature (1)..(1): n is a, c, g, or t
nggacacgtcaactataggctaggtacgaggctgggtgttgcttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacaggtcgcctgtgtaacgctgagcgggcggggtgagaggctggagggctgccgaacctgacggcgcccgtctgtgtcgggggagggcgcttttcggcaaccgtgggccccgcggggggggggggcccctccgg

SEQ ID NO: 292230 - DNA, 322 bp, Homo sapiens
gcgtttgcaggcgtgtttacatgcaggcgtagcaccatgtgagaccactggtccagggtttcagaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292231 - DNA, 1311 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292232 - DNA, 1400 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatctaacttcgtgcgcaatcagcttctatccttgacttagattctggtggagagaagtgagaataggcagcccccaaataaaaaatattcatgg

SEQ ID NO: 292233 - DNA, 1262 bp, Homo sapiens
  misc_feature (1)..(1): n is a, c, g, or t
nggacacgtcaactataggctaggtacgaggctgggtgttgcttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292234 - DNA, 1053 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacaggtcgcctgtgtaacgctgagcgggcggggtgagaggctggagggctgccgaacctgacggcgcccgtctgtgtcgggggagggcgcttttcggcaaccgtgggccccgcggggggggggggcccctccgg

SEQ ID NO: 292235 - DNA, 1043 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacacctggggctcccctggtgtataagctggaaggggctggcggaaaagcctgggaagtgctgccgtaagccggacgcttgccccgggtcgggggtcggaaggcgagggcgcctttgtcgggca

SEQ ID NO: 292236 - DNA, 1282 bp, Homo sapiens
aacgcgcgaggggaaaacatcggctggtcgggctggttgtaatccttcgtagcttcgctcggtcttcttcttggtgtgtaggcggccgagaatcgccatggccatgtgcctagctgcgtcgtggcccatcctctgctcgtccggagcggttgattctgctggtctcccttgtgtattcgtatgagttgcgatacgccctggttgccctgacatcattgagatcggaataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292237 - DNA, 1690 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagatacagggtctcgctctgtgacccaggctggtcttaaactcctggcctcaagcgatcctcctgcctctgccttccaaagcactggaattacaagtgtgagccgctgcaacccgccagaaaaaagtgtgcctttcatggccctgtctgggtggctagacacgtgtgtgtgctggtggtcctggcccagccagagtccctgagaggagcatgcatggcctaaggaagtgagcttcagggaacagtgatgaccatcatttcacactcggacccctgcccagatgggtggatggctggcaggagggattccggttttctgcgcctggagaagccctggcaagcggaacctgaaagtatgccctgtccttttcttctcctcagaataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292238 - DNA, 1243 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaagattgacggcgtggaggacatgcttctcgagctgctgccagatgactgatgtatggtcttggcagcacctgtctcctttcaccccagggcctgagcctggccagcctacaatggggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292239 - DNA, 1636 bp, Homo sapiens
agcgggtcctcccgccccgccgcttggtggcggccgcatgctgcccggatataaagggtcggccccacatcccagggaccagcgagcggccttgagaggctctggctcttgcttcttaggcggcccgaggacgccatggccgagtgcccgacactcggggaggcagtcaccgaccacccggaccgcctgtgggcctgggagaagttcgtgtatttggacgagaagcagcacgcctggctgcccttaaccatcgagatacagggtctcgctctgtgacccaggctggtcttaaactcctggcctcaagcgatcctcctgcctctgccttccaaagcactggaattacaagtgtgagccgctgcaacccgccagaaaaaagtgtgcctttcatggccctgtctgggtggctagacacgtgtgtgtgctggtggtcctggcccagccagagtccctgagaggagcatgcatggcctaaggaagtgagcttcagggaacagtgatgaccatcatttcacactcggacccctgcccagatgggtggatggctggcaggagggattccggttttctgcgcctggagaagccctggcaagcggaacctgaaagtatgccctgtccttttcttctcctcagaataaaggataggttacagttacgggtgctcttgcgtcgggaagacgtcgtcctggggaggcctatgacccccacccagataggcccaagcctgctgcctatcatgtggcagctctaccctgatggacgataccgatcctcagactccagtttctggcgcttagtgtaccacatcaaggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttctcagctggatgatggtcttcagcctctttctgtcccttctgtccctcacagcactagtatttcatgttgcacacccactcagctccgtgaacttgtgagaacacagccgattcacctgagcaggacctctgaaaccctggaccagtggtctcacatggtgctacgcctgcatgtaaacacgcctgcaaacgctgcctgccggtaaacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttatcta

SEQ ID NO: 292240 - DNA, 424 bp, Homo sapiens
atttgccttggctcagaaggcctctgggggccatccctgaccactaggcttcccacttagacctgctccagcagcaccacccctcgccactgcctggtcctttccttcacccttgattctgtcttcttttgtccttctccaggtcttggcagcacctgtctcctttcaccccagggcctgagcctggccagcctacaatggggatgttgtgtttctgttcaccttcgtttactatgcctgtgtcttctccaccacgctggggtctgggaggaatggacagacagaggatgagctctacccagggcctgcaggacctgcctgtagcccactctgctcgccttagcactaccactcctgccaaggaggattccatttggcagagcttcttccaggtgcccagctatacctgtgcctcggcttttct

SEQ ID NO: 292241 - DNA, 337 bp, Homo sapiens
aacacgcctgcaaacgctgcctgcccgtaaacacgcctgcaaacgctgcctgcccacacaggttcacgtgcagctcaaggaaaggcctgaaaggagcccttatctgtgctcaggactcagaagcctctgggtcagtggtccacatcccgggacgcagcaggaggccaggccggcgagccctgtggatgagccctcagaacccttggcttgcccacgtggaaaagggatagaggttgggtttccccccttttatagatggtcacgcacctgggtgttacaaagttgtatgtggcatgaatactttttgtaatgattgattaaatgcaagatagtttat

SEQ ID NO: 292242 - DNA, 2406 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctcca

SEQ ID NO: 292243 - DNA, 1112 bp, Homo sapiens
tctttatttctttttgtggatttgagctcccatcttagacacaggctcaagatggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292244 - DNA, 751 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttctgtatccttgaatatcttgaaatataccttcttttgatttggaattgtttggatatttttaacagtatttttgtttgaaagctaacactccataggagttacaacctacaggaattcttaaacttttgcttcttggcctccttttctcaggaattgcctgatgcagccattgccagagactgcctgtcactgt

SEQ ID NO: 292245 - DNA, 5341 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292246 - DNA, 5591 bp, Homo sapiens
gaagactgtgaatttattcattctgtcttgctttcgggcatagcgacatggggagttagagagttattacacatgttgtgacatgtgccctaccttcaaggtgggggttaagtgtacacatgaggcgtaagtgtacaccaaatgactgacagcaaagtattcatatgaaagattattaaaccatgataaaatgcaatgcaaagatacagcttcttgttttacagatgttctcttaatgatttcctggactttatatcatctgttaccattttccaacttctcttatacttagaatccttacgttcttacagttgagactgattacattagtttttgattcctttaaaacaaataaggaaagatgctttttttagtgtgtttttaatataatatacttactgtagaaatacatactaaatcttattagatgtctctgcttcagacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292247 - DNA, 5186 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292248 - DNA, 5381 bp, Homo sapiens
gaagactgtgaatttattcattctgtcttgctttcgggcatagcgacatggggagttagagagttattacacatgttgtgacatgtgccctaccttcaaggtgggggttaagtgtacacatgaggcgtaagtgtacaccaaatgactgacagcaaagtattcatatgaaagattattaaaccatgataaaatgcaatgcaaagatacagcttcttgttttacagatgttctcttaatgatttcctggactttatatcatctgttaccattttccaacttctcttatacttagaatccttacgttcttacagttgagactgattacattagtttttgattcctttaaaacaaataaggaaagatgctttttttagtgtgtttttaatataatatacttactgtagaaatacatactaaatcttattagatgtctctgcttcagacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292249 - DNA, 5131 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaaggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292250 - DNA, 5287 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaatactttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292251 - DNA, 4945 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292252 - DNA, 4639 bp, Homo sapiens
tcctggtacagagggggaacaaaacaacttgtatttggagcagtggagaaaaattcagtttttaaagacataaggaaagcttagtgagcaaaaaaatttccttacagactgattttttttttttaatttttaggttttgtgggtacgtagcaggtatatatatttatggggtacgtattttgttataagcatatagtgcataataaccacagggtaaatggggtatccatcacttcaagcatttagggactgataattctaatttttaaattttgattgtgagctagctttccttgttgtcatataattacaagtcagtaacatgtccaatatatttttctcatctttccacgtttcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292253 - DNA, 4365 bp, Homo sapiens
agtctagaggagtccctacatacaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292254 - DNA, 4552 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttggttgagcaatgtttaaagcgtttgaaaaacatgaatttggagggctcaattcaagacctgtttgagttgttttcttccaagagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292255 - DNA, 3477 bp, Homo sapiens
tcgagctcggactcaccttatctgcttctgtcataatgcagcgcatgaagggtgagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctgataggggatgttgctcgtactgttgctctgaggggagtacatcttgagtattttcaaataatgatgtgaagtttgaggtaggtatctttccaatgttctaactttactagaattaggttattaagcttctctagtgcccttaacttttgttacatagagatttaaagaaaaagaaagtagtaccttagtatgtaccgcatccttcttttcctcagccaccctatcataacagaagttatttcccttccattctttatttggctttgttctttccctgtctgccttctccattttctcagttatctctaccagtggttctcaaactttagactttttgagaatcacctggtgggttgctaaaagatgcagattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292256 - DNA, 2391 bp, Homo sapiens
gcagcggtacggtcgaatacgaatcgtaccagcgtcggattagccctttcccagagactgataaacaggggccagaaacctgcatttttaacatggagcccaagtgattttgatccaggtggcccccaaatccagttatataaacactactttagcttctctcctgaagccttaagtaaactggtttaattcttaatctgtagtcagttttcatattccttttggctttctaccaagtggtagtatccatttagtgccttaaaatacagacaataccaaggagatttcattctagacaagtctagaaatggccattaacttctaagtgtccttgtgttcaatgaatatcctttacctattgggaaatagaaggtaaattagtaagagaactggtgtatagctttgtggaccatagggcttatttgctgagagttgtctatattcatgcacccagtcccctaagtagcctcttttaatacttcatttagctgattcagaaaaaaactccctgggaattaggagatttaaggttcagtcttgcttctcctacttgtggcttcactgagctagtcagtttcctcaggcttaggtttctggatttgaagtggaattttttcaagaatgaaacttttatagctgaaataaactttggagcttatctttcattggaaaaaccagggtggttcagtgagttaaggacaatatagcatggactgggctgccagtctagcatttgtttccaaattcattcatgttcttttggagtatcttcatctcctctcattttcccatcttctgccctttactattctgggaaaatggcaaaaaagcttcacatgtgtccacaaaatgacaatttgtatgtttataaggaattcagtattctgtatcagttactttttccaaataaatccaaatatttaacatttaaaaaaatgcaatctaaagtataccaaactgtaacttacctagtaaatgagattagaaactattgtcagggtcatcgtagtgaattattattattattattttttgagacagagtcttgtgctgttgcccaggctggagcacagtggtatgatctcagttcactgcaccctccacctcctgggctcaagctattctcccacctcagccgcctgagtagctgacactataggcaccaccatgccctggctaattttttaaaaactttgtgtagagatagggtttcaccatgttgcttaggctggtctcaaactcctggactcaagggatccacccactttggtctcccaaagtgctgggattacccacatcctagtaccaactttatcacttctgatggcattaggacacacaggccatttataagagcagtgtttgagacctcctgtgtgtcacttccaatcctcttggccttcatactaaagtcactgctgtggcaaccagtttcaagcagggctgaaccttgcctcttgctctggggatgtctcacttcctgcccctgggcttctcaccagctacaggaactgcctagcacttgggtatgtacaacctggaagaggtgtggggccaccccatcccctcctcaaagaaattcacaggcacagtatgaggctaaagtaacttccatcttggatgctaatctaccatgttgacttctgataaccagttcctggaatgccctctaagatttctacttttatctattaaaagaacacacacacacacacacacactgtaaatcctggccttaagcaagttataggctaagttgtaaacagcattcttgcctttccctgaggaggtgacttcagtgtctcacatgttccttcatgtacccccttttctctatggcatataagccctgggtcggggggtaactgtggggatcactgcctgagacatggcttctgtgcataagtccctattaaatgtttctttctgacaaactggatttgttggcctctttctttggcatctcagcactctcagcctttgggggtaggttgcatagacctggtcactatacaacacatatttcctaggacttgtcacaagttccctcaagatctagcactagtgcctatgttttggctaactcaatgaatatgttgttaataggcttgtctgtcttgtttcattttgccactgttccctgggatcacttcccaaatttacatatgtaagcttttggctcaggctctgcttataggagaaccaaggataaatcaaagcagtgaagtaacactggcagacaaaaagatgacttctaagataattcttttgttactatatattttatgaatgtctatattaaaaaatcttttttttggctgaaaacattcctgcttagattagaccaattctgtcaactataaaactgacaatatattcagattgttttct

SEQ ID NO: 292257 - DNA, 2352 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctcca

SEQ ID NO: 292258 - DNA, 1886 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggagaccagttttgattttaaatgttctcaatccagactaaagacaaccaagtattcttctcagaaagtgataggaactcctcatgccaaaagtattgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactaggtaggtatattgcaaaaattatgttactttactttttctgttgttgttatgagtaaaagtattcaggtcacttttctttaaaatgtgatgtccagcagccgcagcggggctaaattgggatgtactcaaactgcaattgcatttgctgcttttattgtaagagcaaagctgtatcattggaggaagaagataaacaagttaattggacttcagtccccgttatgctcttcatcatttccatcagctcattcaggaaccattaagagtgtctagtgtgctgagcctgaggatacaactgcataaagacgtgacttggtcttcagggagctcagggtcttctgggaaaggcagcccttctgcagacagcttcagtgcagtgcagtgggataagggcatgagagcagaagcagaaggtgcctgccttccatgaggcccacacaagactgctggggtgttgtactgttgctacttgctactgtttgtagcagctggactctatctatatttcttttctgtgatttttatattcacaactgtttaagggtgcttatctttgcttgtgaac

SEQ ID NO: 292259 - DNA, 1213 bp, Homo sapiens
ggcccggactgggtcccatcgccccacctccggtcgctggacgtgctctcgcgtagctccgcctttcgtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaaaaacatgaatttggagggctcaattcaagacctgtttgagttgttttcttccaatgaaaatcagcccttaactaccaaagtatgtgttgtccccagtcagccagtggtggagttggtgttgatgaaggttttgggagcctgcaagttgttgctccgcttgttggactgctgctgcaaaacttttcttttgactgtgaaacatctaggtttgcaagagttcattattttaaaccttgtgatggttgggctggtgagcaggttatgggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgtttttaataaatgagcagtcaccaagagccagtgaagaaaccttgcttggaatttcaaaaaaagctaaacaaatgaagatcaatgtacagaataatgtggatcttggacagccagtaaagaataagagagtcttcaaagaagagtcatcagaatttgatgtgagggctttctgcaaccagctgaaacacaaagctactcaggtttgtctggcttcattaaatttagcttatgatttctgctaatttgtagaggatgcttcttaccaagggcagagattgaatcttttcattttatccccagctctaagcttagtgccttcttagttgtcagtgtgtgcttctgaatgaataga

SEQ ID NO: 292260 - DNA, 337 bp, Homo sapiens
ttactgtagaaatacatactaaatcttattagatgtctctgcttcagacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggtgaggaagcccggtaggtgagacccaacctgttcacttgaaaatgtagatcacactgccacttactatattgctatttatggaaatctcgtggaaatctcagtaaattacttgtgttttataggcctatagccc

SEQ ID NO: 292261 - DNA, 286 bp, Homo sapiens
atgtaatctgcaaattgtaattactggctaattaatgagctcctatttctttctctagggttctctataaaggtgtcttaaaaaggttgattttgttatatgagcctttgtttggattgcttcaagaggtcgctaggattcaaccaatgccttacttcaaagattttacctttccttctgatatcactgaatttttaggacagccatattttgaagcctttaagaaaaaaatgcctatagcttttgcagctaaaggaataaataaattgctaaataaactgttttt

SEQ ID NO: 292262 - DNA, 383 bp, Homo sapiens
cacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaa

SEQ ID NO: 292263 - DNA, 292 bp, Homo sapiens
tggaacagcttgttggagtggttgaagatgatgagtgcgatctcgcagtcacatagcacgctcagctcatacgccttcttcatcaggccaaacttccgcttggtgaaagtcacctgcagagaaggatgggtgggcggccagatctggctcagttaaggcctgattgggagtcccagcctacagatggctggacatagcccctgccctcaggagcccccattctcagtgtgacacagcccctggtctcaggagtccctggtttggggaaggaccaggctagtgcctgtaggcc

SEQ ID NO: 292264 - DNA, 2758 bp, Homo sapiens
acagcaatctcgggaaattggagactgacgcggctgctcctgcatgttatttatttttcctctttccctcccgtggagaccctcctgttggaaagagagctgcagcacgggacagagacaggcaggaagaagcagagaggactcggtgacgcccccaccgagcagcccctggcccactcctccagcaggggccatgagcaccaagcaggaggccaggagagatgagggagaagccaggacgagggggcaggaggcacagcttcgagaccgagcccacctgagccagcagcgccggctcaaacaggccacccagttcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgtctcagccgcctggggttagagaaaagggtcctaaaagcctcagctggggacctggcccctgggcccccaacccaggtggagcagttggagctacagctggggcaggagactgtggtgtgctcggcacaggtggtggatgctgagagtcctgaattctgcctgggcctgcagactctgctttctctcaagtgctgcatcgacctggagcacggagtgctgcggctgaaagccccgttctcagagctacccttcctgcctttgtaccaagagcctggccagtgactgctgtctcagtcagtccccagagggaaagaccttgccttagaagaagaggcgtgtggggaacgggggctcttgaagccaggtagctggggactatggtgtctgcccttccaatcacctccctgacccctgctgtcccattttccccagctggccgcattcctctctgcttctcagcagctgtcctactccccaggacgagttttcactagagggcccacgatgccaggattctgattcatcttcctcccaagaaaagcaaagccaaatcaagaccacagataggaacctaagcacaatggggtgcctgcttgggctgggtcgaaggctctgctgactgctgtccttgtccatcacccaataccaccccaaacacaactcaacttcccacaccaccatgtctctcaccacaccttctgggcctcattatctcccacaactagaccgccatgcctcaccaacctatgtccctggacctcctggtgtctgcctctcggagtctgtgcacatctgctcacagttgagtgggggaagaaacagccagaattcaatacaacaaagagcgggagttagtataggaatgtccatctcataaggctgagagctattttttcctgtggctgcaaatgtctgaagccagttagtttgattaccctgtgcaaaaccttggacatacttctgctattaacgctataggtatttatccgtttccactggctttttgtacccaccgagcccctgagccttgcgtgtgtgtgtgtggaagagccttgtagagaactgctcctgtgaggcagacaggacagtgaggttgtcaccactcagacttcacctattcagcattctttctgatttctagaactatccacctcattaggccttcttcctatccccatctctggcctcttgagcttaagcttgtattgtcctggaatcagtggctttctaaccccctgccaggctttgccaaagcaaaaagacagaggctttttttttttttttaaagtttggggtctgtcaggagacagaggcttttttgaattcactgtgaagagaagaacccgaaccttaagacgccagatccctgagagtctttctggctggtttgagtctctcaaatcatggattaggagtaaagaaagaggccaggcgcaatggctcatgcctgtaatcccagcactttgggaggctgaggtgggtggatcacttgaggtcaggagtttgagaccagcctgggtaatatggcaaaaccccatctctactaaaaaatacaaaaattagccaggtatggtggtgaacacctgtaatcccagctacttggaaggctgaggcataggagttgcttgaacctgggagatgggggttgtagtgagccaagttcgtgccatcggactccagcctgggtgaaggagtgagaccctgtctccaaaaacaaacaaaaaaggagcagagaaagacagtggtacagctaacctgaacaagggaactgggaccgttgggctgaaacagtcttgagcctggggttgactgggttagagaagaaccgggatgcaaggagctgcctgtgacacctggcctgccctttctcagctgcctcccctgccctttctcagctgcctcccctgccctcagaaggaaaggagagggctcacttatcacttgtgccatagcacctggtctcaaaatcctaaaagctttcctcgccctcactgccttgctccacaaggtccactttcctgggtcttgtgctgtgcctttccttgtctgcctcctgctgcttctgtaactgcagaccccaggcccaatggcaagccctcggctcagctgcttctccattggaataaactcttgtttctctaaaaaaaaaaa

SEQ ID NO: 292265 - DNA, 975 bp, Homo sapiens
gcattcattgatataccttccggtaacatatcttatagtaaatactcaatgaatgtttggaatgagaaaacgatgtgtgtgtatatccaagcgtatatcaaaatgtctatgtcccaaagtaggtgaagttgtcttcctttgtttccaatagcgaacttcttggttactcatatctgagtttcctaacagggattccagtcttctcatccttcctctattcctaacctggagttttcgaaccaggaggccatcaaactcccaaggattcctctaaacaaacaaatcaccgtttctccatttctggcagatcttccccaaacttatgaacccatcacatataaccactttttttttttccattttattttttgtagagacagagtcttgctatgatgcctaggctggtcttgaactcctggcttcaagtgatcctcttgcctccaaagtgctagaactacaagcatgagccaccgcacctggtccacttcctttttgtgatttatttatctgggagttctgcccctattgtatgagtctcataaaaaccagtttttttgtttgttttgagacagagttttgctcttgttgcccaggctggagtgtaatggcgtgatcttggctcaccacaacctccgcctctcgggttcaagcgattctcctgcctcagcctcccgagtagctgggattacaggcatgcgccaccacacccagctaattttgtatttttagtagagacagggtttctactaaaccctggtcaggctggtcttgaactcccgacctcaggtgatccacccgcctcggccttccaaagtgctgggattacaggcgtgagccaccgcgcctggccccgataaaagccagttttaaagacagttcattttctccactcatttctaggagggaatcatcaatgggctgggaaactgaaggatccaattccaacccattctcctagggactcactgattcacc

SEQ ID NO: 292266 - DNA, 1239 bp, Homo sapiens
acagcaatctcgggaaattggagactgacgcggctgctcctgcatgttatttatttttcctctttccctcccgtggagaccctcctgttggaaagagagctgcagcacgggacagagacaggcaggaagaagcagagaggactcggtgacgcccccaccgagcagcccctggcccactcctccagcaggggccatgagcaccaagcaggaggccaggagagatgagggagaagccaggacgagggggcaggaggcacagcttcgagaccgagcccacctgagccagcagcgccggctcaaacaggccacccagttcctgcacaaggactcggccgacctgctcccgctggacagcctcaagaggctcggcacctccaaggacttgcagccgcgcagtgtgatccaaagacgcctggtggagggaaacccgaattggcttcagggggagcctccccggatgcaggacctgattcatggccaggagagcaggaggaagaccagcaggacagagattccagctcttctggtcaactgcaagtgccaggaccagctgcttagagtggccgttgacacaggcacccaatacaatcggatctctgctggatgtctcagccgcctggggttagagaaaagggtcctaaaagcctcagctggggacctggcccctgggcccccaacccaggtggagcagttggagctacagctggggcaggagactgtggtgtgctcggcacaggtggtgggtaagtccccccttctgcaacagccctggtgctcacctcacctttctctttggggtggggcaaaggctgagactttcactccctgcagcacgaggagttcccagagatgttctgactatcccccatctctgtgccagtgtcctcggatctggggatggggtgggcagagaaggagcaacggctaagaggagggcagcagtgaccactgggaaccctcagcctcttctgttttcaaattgttcctatagatgctgagagtcctgaattctgcctgggcctgcagactctgctttctctcaaggtaaggcacccactcagggcctgacccaaagcactgggaaaaagtagtagaaggcacaggtgtggaacctggaccaggttctgatgagagtgacttagagatgggcaactgtccctttgcttccttagaggttccttacttaccaccaagtgaaaaatcaagaggactgggtcacccccttcaacaggagtctag

SEQ ID NO: 292267 - DNA, 811 bp, Homo sapiens
acaggcgtgagccaccgcgcctggccccgataaaagccagttttaaagacagttcattttctccactcatttctaggagggaatcatcaatgggctgggaaactgaaggatccaattccaacccattctcctagggactcactgattcaccacgattcttctttcttagtgccaggaccagctgcttagagtggccgttgacacaggcacccaatacaatcggatctctgctggatgtctcagccgcctggggtaagaatgtggcccaaacaagcaagtgggggacagggtttctttttggggtgatgaaaatattctcaaattagatagtgacgacagttgcatattttatctcaataaagctgttatttaacaaaagagtggctagaagactctggcagagaaggcaaggatttagaccccacgtgaggtcaggggttggagatgaaaccatagtagagagggacacctgctgattaatggggtggaaccctctaggggctgtggtagccataacccttgcttcccaaccacaggttagagaaaagggtcctaaaagcctcagctggggacctggcccctgggcccccaacccaggtggagcagttggagctacagctggggcaggagactgtggtgtgctcggcacaggtggtgggtaagtccccccttctgcaacagccctggtgctcacctcacctttctctttggggtggggcaaaggctgagactttcactccctgcagcacgaggagttcccagagatgttctgactatcccccatctctgtgccagtgtcctcggatctggg

SEQ ID NO: 292268 - DNA, 197 bp, Homo sapiens
ccgcacacagaaagcactcagtaaatgctgtttccccccttccccctatacaaagagctatggggaccggaaggcgaaacagagctgtcgacgcgggagcatacgctgcccaccagtggagcgcaggtaaagaaagagcgcgcgatttcccggcgcggagaggggtgggggaagccccaccaggactgggcggcgcc

SEQ ID NO: 292269 - DNA, 1716 bp, Homo sapiens
ggcacgaggggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagtaagaataaataagaatttacttgcttttgatgttacaaatacatttttaatgccagagttttctttttgtcattgttactgtttctgttattatttgcaatactgtggtagagagaatgatggccaccccaaaaaacgtccacctcctaatccctggacctgtaatctgctatcttacatggcaaacgggactttacagatacaattaatttagagaccttgaaatggggagatgatcctgggttatgtggtgggcccaatctaatcttgtaggctttaaagagtggagaacttttcctggctgtggagaaaggaaaatgtgactatggaagagtcatcagaaacatgtaatgttgcaggctttgaagatggaagagggaaccaaggaatgtggatgacctctagaagctgaaaaaacaaggaaatagtttgtcctttccagcccccagaaaggaatgaaggcctacaccttgactttaggcagtaagacccgtgtcacacttctcactgacataactggaagataatatatttgtgttgttttaaaccactaaatttgtggtaatttgttatggcagcaattaagagtaatacggattttagtacttggcagtggggtgtggctatcacatattcctgaaagtgttggggtgtctttgagattgcgcagtggaaagaggttggaagaattttaaatagagtgataggaaaatcctagatgaaaaaatggaaattaagtcaattaataaccctacaatggcctgtaagtgctcaagttaaagaaagagtcggccgggcgcggtggctcacgcctgtaatcctagcactttgggaggccgagacgggcggatcacgaggtcaggagatcgagaccatcttggctaacacggtgaaaccccgtttctactaaaaatacaaaaaattagccgggcgtgttggcgggcacctgtagtcccagctgcttgggaggctgaggcaggagaatggcatgaacctgggaggcggagcttgcagtgagccaggatcgcgccactgcactccaacctgggagacacagcgagactccgtctc

SEQ ID NO: 292270 - DNA, 3586 bp, Homo sapiens
  misc_feature (1609)..(1609): n is a, c, g, or t
ggcacgaggggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaacgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatccttcaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagtaagtgacatgcaggcacctctctttcatcctttaagggaccttccacctgccatgcgcactctccagcagaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgncccagggggttgaggaaaaaaaacaccagttgtttatattttgtgcttattcatacaagacaggaagcacggtcttaggcggatggaggcctgacgtccctggagttgaaagcccagtttctgacacacaggcctggcaggcaggactccttgtgctcccagcagctcagacagggaaaggatagtccccactcacggtgacaccaccttcctgaggcttccctcctgctgctaccactgatgcgagggaaaggccagtggctggagaccccatgtgcagttcttggatactctgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagtcgtgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaatttttt

SEQ ID NO: 292271 - DNA, 2671 bp, Homo sapiens
ggcacgaggggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaacgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatccttcaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaaaatgtctgcttgtgtctagatggggaaggagcaggttcatcgggtactgggacccagcagtgtgatccagagagcagtgggagacgctggcagcaggaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaatttttt

SEQ ID NO: 292272 - DNA, 3734 bp, Homo sapiens
  misc_feature (1537)..(1537): n is a, c, g, or t
ggcacgaggggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaacgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatccttcaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaaaatgtctgcttgtgtctagatggggaaggagcaggttcatcgggtactgggacccagcagtgtgatccagagagcagtgggagacgctggcagcaggaggtaaatgctctctgtgctctcagggacacctcctctgatatgctgaggccagtgttggggacctttgcctacatactggtattgtcctttccttgaagttttgcagtagggtctcctgncccagggggttgaggaaaaaaaacaccagttgtttatattttgtgcttattcatacaagacaggaagcacggtcttaggcggatggaggcctgacgtccctggagttgaaagcccagtttctgacacacaggcctggcaggcaggactccttgtgctcccagcagctcagacagggaaaggatagtccccactcacggtgacaccaccttcctgaggcttccctcctgctgctaccactgatgcgagggaaaggccagtggctggagaccccatgtgcagttcttggatactctgggaggtgttcccctccctcccatgactgagcccatcagccattcctgaaggaagacagtggtagccacaggaacggtggccatttccaagctccctgccctctgctcacccatgtccaatctctcaggaccccgtggaattgcatcttctgcaggatgaaggagtctccgggaagccaacagtgttgtcaggaatctgaggtcctggagaggcagatgtgtcctgaggaacagttggtaaatcagatgcaaaccccaagccttctcctttcccctcacacgtgagaaccatgaacaagcgcaagggcaggggaatgtactgaaaggagcctgctcttccgcgccacacttcaatggcactgatagaacaccacaccttgtttgcacaaaaaataactcagccatgacatgtctgtttccaagagccacacatgttagagaaacttgaggaagaagggtgtgagtcgtgtgctgtgtctcatgcatgtgggctcattctctccaagctgcttttcatttacggcctctttcttttgcagaaatgtgagttcctcctcttgaaagtctattgctgttctgagagctccttttttgccaagattccatactattattatgtaagtaacaacagcaacccatgattacaggctgccatgacattacctgaccctgaaatgggccctcgtgagatttgtgatcttaatcccacggggcaagagcacacgctgtcattagttgccttcaccttgttgtatttctgctggattttatgggaatccacagaaggtagacactgaactatgctggtagcttttccattggtatatttgtcaccagattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaatttttt

SEQ ID NO: 292273 - DNA, 2572 bp, Homo sapiens
ggcacgaggggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaacgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatccttcaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaagaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaatttttt

SEQ ID NO: 292274 - DNA, 1860 bp, Homo sapiens
ggtgatctagcggatcctctctgacgagttcacagaaaagagtccgatcaagagcttcaagaaagcacaaagatgaaactgtggattttcaggctcctttacttccagtgacctgtggtggggtgaagggaattttacataaggagaaattggaacaaggaaccttggcaaagtgtatacagactgaggatggaaaatggttcacccccatggaatttgaaatcaaaggaggctacgcaagatcaaagaactggaggctgagtgtgcgctgtggcgggtggcccctacgacggctgatggaggaaggatctctacctaatccttcaagaatatattacaggaacaaaaagagaatactgaagtctcaaaacaatagctcagttgacccttgtatgagaaacttggatgagtgtgaggtgtgccgggacggaggggagctgttctgttgcgacacttgttcaagagtcttccatgaggactgccacatcccacctgtggaaagtgagaaaatgtctgcttgtgtctagatggggaaggagcaggttcatcgggtactgggacccagcagtgtgatccagagagcagtgggagacgctggcagcaggaggaccccgtggaattgcatcttctgcaggatgaaggagtctccgggaagccaacagtgttgtcaggaatctgaggtcctggagaggcagatgtgtcctgaggaacagttgaaatgtgagttcctcctcttgaaagtctattgctgttctgagagctccttttttgccaagattccatactattattatattagagaggcgtgtcaaggcctgaaggagcccatgtggttggataaaatcaagaaaaggctgaatgagcacggttacccccaagtggaggggtttgtacaagacatgcgcctcatcttccagaaccacagggcctcttacaagtataaggattttggccaaatgggacttagactggaggctgaatttgagaaggatttcaaggaagtgtttgctattcaggaaacaaatgggaacagttgactggtttagtggatgctgaaggccttcaggaaatatgctactggttgccactgacttcaaactgagagcacttgggaaatagcacatgcagggagaggcttttctctgagcctccctcatctgcccaaaaacaaatcctcaaaagaaatttgatcatcatgaatcccatccccaagaatctcatcaaccagggaagaggaactgagatcacagggaaggagattggaggtgataccagcacagacagactctcacctcttctcctgaggtctgctccagacaacatttattactcacaagacctttttcctccgttttttttttgagatggagtctcacacagtcacccgggattggaatgcaatggcgcgatctcagctcactgcaacctctgcctcccggattcaagtgattctcctgtctcagcctcccaagtagctgggattacagtgcctgccaccatgcccagctaattttttgcatttttagtagagacggggtttcactatgttggccaggctggtctcgaactcctgacctcatgagccgcccgccttggcctcccaaagtgctgggacgtgacaggagtgagccaccacacctggccactcgcaagaccttttatctgaaaaccagccaagctttattcacgacacacttcttcccttcactctcccacttctgtggtcaactccctgcagaactcccaaactgccgttcttttcgatagctcacgatggtgtatgagtgtcaatcatctgacccttcttggagtctcatatttcgtggaactcctgtgcaaacatatattattaaatttttt

SEQ ID NO: 292275 - DNA, 1521 bp, Homo sapiens
ggcacgaggggcgggcgcccctcccccagcgtcactgccgccttgcagtttgatctcagactgctgtgctagcaatcagtgagagtccgtgggcgtaggaccttccgagccaggctgttcacggaagaccaggatgtagatgagggacttgtctatgacactgtattcaagcacttcaaaagacataagctggagatatcaaatgcaataaaaaagacatttccattccttgagggcctccgcgatcgggaactcatcacaaataaaatgtttgaagattctgaagattcttgtagaaacctggtccctgtacaaagagtggtgtacaatgttctcagtgaactggagaagacatttaacctgtcagttttggaagcactgttcagcgaggtcaacatgcaggaataccccgatttaattcacatttataaaagcttcaaaaatgcaatccaagacaaattgtctttccaagaaagtgatcgaaaagaaagggaagagaggcctgacatcaaactaagtcttaaacaaggagaagtgccagaaagcccggaagcaaggaaggaaagtgaccaagcatgtggcaaaatggatactgtggatattgcaaacaactctactttgggaaaacccaagaggaaaagaagaaaaaagaaggggcatggctggagcagaacgggaacgagaacgcagaaaaacaaccaacaaaatgataacagcaaagccgatggccagctggtctcgagtgaaaagaaggcgaacatgaatctgaaagacctttccaagattagggggagaaagagaggcaaacctggaacccactttactcagagtgacagagctccacagaaaagagtccgatcaagaggtaaaaaagaaaagaggaatgcactttcaataactaaacatctaatttcctgtgctttatgctgtattttcagtaataaacctatttctttaattgttttatgaagctatactaactattgaaaaacatatcttattaagtcattttccaaaaaaaaaaaaaaaaaaaaaaaaaaaaatttggggggggcctggggcccggaaaaagcgttttcaaaaccaatccggtggggggcgggggcgcccacaggggacagggagacctggcgccaaaggctggtgccctaagagaaacccggggcagagacagggcgcggggttcccaccaaataaaaaacgcgccgggggggaacccgacgggtttctgtgaacaacttccagatgggaggctcagagagggcgataccgggggctcttttacccagggggggcccaagggagcgtcggaaatttcaaattagcgcgagcgccgggggacgccaagtaaacagaaggcagagagaggaaaagaaaaacaaaaaaaaaacaaagaaaaaaaaaaaaacgagacaggaagaaaccaagacgaaaaagcaagaaaggaaaaaaagaacaaaaagaaaacaaagaaggaaagaacaagaaaaagcgaagaaaaacaggaaaaagacaaaccag

SEQ ID NO: 292276 - DNA, 839 bp, Homo sapiens
ttcttgagattctcctttggctgcttacacaggaaaccaaggcggggagtgccacgggtgatctcatgctggcatgacgtcaagaactcttgacgtcagaaggcggttgccacggacaccgttcgccaccgacggcagagtcgtgaaaccccatcactaccacactcgtctccgtttcggcctctgcagggtgtaagctgctaaagaagcttcaaccttaagggggcctcagggagagagttgtgctcctgccgccgagagctccaccttcgtggctctgggtccggggccccggcctgtggcggcgagcggcggccgctggagacgagcggcggcggcaggcggccagcccgggtctacctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcgagaatgcagaatctattgatcttaaacagtttttcgaccaacatttttcacatatatactatgtgttctttgaaaattttgtgactattgaagctagtcttaaacagaaagg

SEQ ID NO: 292277 - DNA, 886 bp, Homo sapiens
ttcttgagattctcctttggctgcttacacaggaaaccaaggcggggagtgccacgggtgatctcatgctggcatgacgtcaagaactcttgacgtcagaaggcggttgccacggacaccgttcgccaccgacggcagagtcgtgaaaccccatcactaccacactcgtctccgtttcggcctctgcagggtgtaagctgctaaagaagcttcaaccttaagggggcctcagggagagagttgtgctcctgccgccgagagctccaccttcgtggctctgggtccggggccccggcctgtggcggcgagcggcggccgctggagacgagcggcggcggcaggcggccagcccgggtctacctcgctccgtgcagggccgggagagggatccgccatattggagctggggccgaaggtgccttggagccgcggcgcgaggcgggtggaggtggcggccctggcctggatcgggaaggagtcggctctgccctggcccgcaaggctggggagctaatgagcctctctggctagtctcctccccgtccactccctccactttctgccgccgggacccggctgggagccggctgtggcagtggcagtggcagtggcagcgacaggatgttctccaagaagccgcacggggacgtgaagaagtccacccagaaggtgctagacaccaagaaggacgcactgactcgcctcaagcacctgcgcatcgtcatcggtgaggagcgaggggtggcagcgccgaggcctgggttgcccggccttccctctcctgggagcccctgcggactctctctcgggacctggcgcggtgcaggagagggcaaatcgtagcctctgcggagacgcgggagggtgaataattcggagaagcgaa

SEQ ID NO: 292278 - DNA, 3886 bp, Homo sapiens
  misc_feature (2657)..(2658): n is a, c, g, or t
  misc_feature (2660)..(2661): n is a, c, g, or t
  misc_feature (3016)..(3018): n is a, c, g, or t
  misc_feature (3023)..(3023): n is a, c, g, or t
  misc_feature (3026)..(3027): n is a, c, g, or t
  misc_feature (3029)..(3029): n is a, c, g, or t
  misc_feature (3035)..(3035): n is a, c, g, or t
  misc_feature (3038)..(3038): n is a, c, g, or t
  misc_feature (3047)..(3047): n is a, c, g, or t
  misc_feature (3085)..(3085): n is a, c, g, or t
  misc_feature (3103)..(3103): n is a, c, g, or t
atggagcctgcaggggagcgctttcccgaacaaaggcaagtcctgattctccttcttttactggaagtgactctggcaggctgggaaccccgtcgctattctgtgatggaggaaacagagagaggttcttttgtagccaacctggccaatgacctagggctgggagtgggggagctagccgagcggggagcccgggtagtttctgaggataacgaacaaggcttgcagcttgatctgcagaccgggcagttgatattaaatgagaagctggaccgggagaagctgtgtggccctactgagccctgtataatgcatttccaagtgttactgaaaaaacctttggaagtatttcgagctgaactactagtgacagacataaacgatcattctcctgagtttcctgaaagagaaatgaccctgaaaatcccagaaactagctcccttgggactgtgtttcctctgaaaaaagctcgggacttggacgtgggcagcaataatgttcaaaactacaatatttctcccaattctcatttccatgtttccactcgcacccgaggggatggcaggaaatacccagagctggtgctggacacagaactggatcgcgaggagcaggccgagctcagattaaccttgacagcggtggacggtggctctccaccccgatctggcaccgtccagatcctcatcttggtcttggacgccaatgacaatgccccggagtttgtgcaggcgctctacgaggtgcaggtcccagagaacagcccagtaggctccctagttgtcaaggtctctgctagggatttagacactgggacaaatggagagatatcatactccctttattacagctctcaggagatagacaaaccttttgagctaagcagcctttcaggagaaattcgactaattaaaaaactagattttgagacaatgtcttcgtatgatctagatatagaggcatctgatggcgggggactttctggaaaatgctctgtctctgttaaggtgctggatgttaacgataacttcccggaactaagtatttcatcacttaccagccctattcccgagaattctccagagacagaagtggccctgtttaggattagagaccgagactctggggaaaatggaaaaatgatttgctcaattcaggatgatgttccttttaagctaaaaccttctgttgagaatttctacaggctggtaacagaaggggcgctggacagagagaccagagccgagtacaacatcaccatcaccatcacagacttggggactccaaggctgaaaaccgagcagagcataaccgtgctggtgtcggacgtcaatgacaacgcccccgccttcacccaaacctcctacaccctgttcgtccgcgagaacaacagccccgccctgcacatcggcagtgtcagcgccacagacagagactcgggcaccaacgcccaggtcacctactcgctgctgccgccccgggacccgcacctgcccctcacctccctggtctccattaacacggacaacggccacctgttcgctctccagtcgctggactacgaggccctgcaggctttcgagttccgcgtgggcgccacagaccgcggcttcccggcgctgagcagcgaggcgctggtgcgagtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagcgagcgcgacgtggccaagcacaggctagtggtgctggtcaaggacaatggcgagcctccgcgctcggccaccgccacgctgcaagtgctcctggtggacggcttctctcagccctacctgccgctcccagaggcggccccggcccaagcccaggccgactcgcttaccgtctacctggtggtggcattggcctcggtgtcttcgctcttcctcttctcggtgttcctgttcgtggcagtgcggctgtgcaggaggagcagggcggcctcagtgggtcgctgctcggtgcccgagggcccctttccagggcatctggtggacgtgagcggcaccgggaccctttcccagagctaccagtacgaggtgtgtctgacgggaggctctgaaagtaatgatttcaagttcttgaagcctatattcccaaatattgtaagccaggactctaggaggaaatcagaatttctagaataatgtaggtatctgtagctttccgaccgtctgttaattttgtcttcctcacttttcaccttagttttttttaaccctttagtaatcttgaattctacttttttttaaatttctactgttgtctttagtaatgttactcatttcctttgtctgattgttagttttcaaattattgtattattataaatattttatatcaggaaagttcatatttctgaataaattaatagtattcattcctgaagggtgatatgaaagttaaccccacctaataaacataactctaattctgaaannanntttcacactatatgacactacataagaatgtatgatttttgaagtcatattttaagttttttttatagtttttcttattcacacagcttgactttttgacaaaagtttggggtgtaatcatttcatatttatccatgtgtaatttcttccaagcttcatatttggagttttgttttttccaataaggagcaacatggataagtttaagctactcttttcaaggtcacacttgtaagcattagattttcattctaaaacacatatgtcatctcataaaaatatatctgcgtaatgtattctgtctcatgtttaacataggactaatgggttcttccttatctctatcaaaggttannnttatntanncnagtgtnggncctttgggncatgacagctttataatacccagattttctgtgtttanggtgttcgtataggccantagcactaggaccaagtaatgcatctcctgcatttcctcttttcacagcaggaaaatcttaacgagttccaaattctgggcttagaggagctttctgatggtacagtatgccaacatctacttgttttggatggcaacattgttctgattcataaggaatttgaaagaaaatacattgtagaattaatattagttaaccaaacaaaatttattaaaggatatgttggtgaaggagttgaattatttgaggaaaaaacatctgctctcttgtcaggacttttctgtctccaggagcttctcaactttgcagatactctagaatggtattgcatgcaaaataatgaccgccaagatgttcctgccctaatccccagaacctatgaatatgttatattgcaaagaaattaaggttcaaacagaattaaggttgccaatcagctaaacttaaaatagggagactctcctagataatctgggtgggtctatttcaatcagtggaaaggccataaaagcagagttgagtcttccgtgagatgaaaataaattttgtttaaggacagcagcttcagcttatgccccagaattccagcctgcccctcctaactgcctgctgtacagattttggacttgtccagccacgtttcaaaactgagtaagtcacttccttgcaataaattgattactacacatctgctgcctgtttctctggctgaactccaactaacacagattttgatacctggaagtggggtgctactgtaataaacacttaaaatgtgcaga

SEQ ID NO: 292279 - DNA, 606 bp, Homo sapiens
aacacactccctctgccgccagattcacacgttccacatgaagtccctgcagactggatccaaactgaggactcgcccttattcgtaacacagcaccagagagttctcttcacgtgtaatcatgtgaacgagtgcttcagctgtgagcctgtccagccacgtttctaatgagtttcctattaagttagctatttgaccttcaagttattattttcattgttttcttttgattacacccaagtcatttttctagaggctggagatcagaaacaaaacagctacaaactaatgctactcccaggctgtcctgcctcaccctcctgggtttcctggaattcaatattttctagtgccttaaataatgacacttatacttgacactaatttttaaagaaaaaaaaaagactctattgccctttactatggggtctttcggaatgaactgggatagctttcttaatttgcgcaggcagtcaccagcatgcatttgggaaggctcacagagcacagaagaggggcctccacaatggccatgtacaacagtggggatttggatattgaaaggggggtcagattagatgaactgtaacttttaacctgccgagt

SEQ ID NO: 292280 - DNA, 439 bp, Homo sapiens
tgcgtctagagtgttgacagttgtttccatggacttcaaatcaacccaaccctgtgagcacagactttcagcaccagagtcagatttcccaaaaatgctattcttgaagcgtagagccagactcacagatcctgtaaagaaaacagatctttcagcaagtgaaacacccaatcttccattgcatgggactcacagaggttctgagggagagatgtgaatagaaggagtgatcatcactgtggactctatttcttccatctgtgcgtgcaagatttatatctgtatgtgtttgttttaaagttttattgaggtataattgatacacaataatctgtacctatttaatgtatacaatttgatgagtttggacatacttaaatacctgtgaaaccatcaccacaatcaaggtaatagacatagccatcacctccaaaagttt

SEQ ID NO: 292281 - DNA, 742 bp, Homo sapiens
acgggcaaaaaaggtcggacaggcaagactaactagggtagtacatctcccaaatagggcaaatattgttaaactgtgcaatttaacagtttgtggtgttatcaattagcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgctcttctccgtgactcttgtatgtatgtgtgcataaactgaaggccaaataattcccgttcctcttcttcatctgtgccttcactgggaggaagtgatactttcaatttcagtgggttgtctctgaagttgacaaacctcagatttgccatttcttcc

SEQ ID NO: 292282 - DNA, 3164 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacagg

SEQ ID NO: 292283 - DNA, 3462 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacagg

SEQ ID NO: 292284 - DNA, 3263 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacagg

SEQ ID NO: 292285 - DNA, 3799 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacagg

SEQ ID NO: 292286 - DNA, 3757 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacagg

SEQ ID NO: 292287 - DNA, 3490 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacaggaaaaaaaaaaaataaaaacaaaaaaagg

SEQ ID NO: 292288 - DNA, 2835 bp, Homo sapiens
tattgggaagtaggctttatgcagaataaatcattaaagaaattgagaagatagaagagcaaatttgaatgaagttgataattcatgatagtattattacaaatataaagctgagtaggtttttgctgtttttattgttgagtttttaaaaacagtactgcttaataaatgtaaaaagtatttatttttaaagatgatgtggtttgggggggccacataattgtgtttgcagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaacacaattaattaatgaagtcaccttcaaatttccagagccatacatgtatatattgtcagaatctgtccatgacaaacacaaaactgaagagctgttttcaaagaaaaaagattatttcacttaattattttgttggataattgtctagttagaacttccaaaaagatacttacaaacataattcacaaatttgaaataatttctgaagttgattagctatctcatatcttttatcaggtcattttttatatatgtaggcacaaacaataagtatgttctcttctgtttgggaaaataatttggaataaaatagaaattagataatgaaaccaaaaaccttctcaaatttaggccttatttaactcatgactggtttctatgcacaagaaaatactaaaccaaatatatggtaggactgttattctcttctgcatcttatccctattttgtttctgcctttatttgtaaaaattgtcttaattgatggtacatttgccaagacaaaggttcagaattactaattttagatattatgatattctgaaataactatttttatcctgtagttctatgattatatgatttgtaaataagaagcctaaccaatttaaaattcctgactttagtctcatatatcttgtcagactgtctcggttcaaattccaaacctaccatcttcagttgtgcgaccttgggcatgctacctaatctctttgtgcctcaatttcctccttttaaaatggggatgatgatgataacaataatacctacctcacaaggttgttgtgagcatcaaatgagataacacaagtaaaatgcatagaacagttccaagcacagagtaattcaataaatattaactagtaatagtagtggtagtaactcgtgaatctttttaataacataataggctttgattttattatctctttaagttgttaacttttttcccttgttataagttttatgtcaagtaaggtagtttgtttaagttagttacccatgtccccaatcaagggaacctaaatgaagatatatcattaaataattaacctttttttattgtgtcaagcaatactaatttgtgtcataaaatttgttttgcatcattcaacaatttatgcccagaaataaacaatattctacaacagg

SEQ ID NO: 292289 - DNA, 2463 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgctcttctccgtgactcttgtatgtatgtgtgcataaactgaaggccaaataattcccgttcctcttcttcatctgtgccttcactgggaggaagtgatactttcaatttcagtgggttgtctctgaagttgacaaacctagaagttcatcaaaaaacagtatttttataggtgtcatggaagtgtacatttatttccctggagaaaggtcaaatgataatatactaaattactcgtttttaactggtttcaataactgaacgacttggtgagatgtgatatatctcaagaatcttatgtttttttcctaagagaaaaaaaaacactagctttagacaacttactttcaaagcttataaaagcaactgttagtctagttgcacaggctggagtgtagt

SEQ ID NO: 292290 - DNA, 1623 bp, Homo sapiens
tatcgctatcgtcgaccacgcccccgagcgagccctagaattatggcgacctccgcgacgtcgccgcacgcgcctggttttccagctgagggtagatgcggttactatgtggaaaagaagaaacggttctgcaggatggtggtggccgcagggaaaagattttgtggtgaacacgctggagccatggaggaagaagatgctcggaaaagaatcctgtgtcctttagatccaaaacacacagtatatgaagatcaactagcaaagcatttgaaaaaatgtaactcaagagagaaaccaaaacctgatttctatattcaagatattaatgcaggcttaagagatgaaacagaaatacctgaacaattagttccaatttcttctctatctgaagagcagttggaaaagttaattaagaaattgagaaaagcaagtgaaggcttgaattctacacttaaagatcatattatgtcccatccagcattacacgatgcacttaatgaccctaaaaatggcgattctgcaaccaagcacctgaaacagcaggtatgtttaggctatagtaactactaaacatggcctttgttcatttgttaaaactgttttaaatgtaattattaataagattttattttgtttacctttgagggtaccaaatatttccatttcaaaaatatatagaaacatatacaaaaaattgagggcatggatgtgattctgagtaccgtatattaaatatttaaaggcaagagagaaaaattttaagtcaaatacaaattatcaatgtaagcatactgccttatgcagaaattaccttgctgttttcccatttgaaccaaatgtgtttactctagtttataaaataatcttgtgaagtttgcaggcttctattttaggtaacattgaaaatttaaagttacttggtccaagaagatgctttgttgagtttggagcgggaaagggaaaattatctcattgggttgatattgccttaaaagatgctgaaaaagttcacttcatcctagtggaaaaggtgaccacaagattcaaggtggatggaaaacacagaaagaaaaattcagtgtttgaaagacttcaaattgatattcaacacttgtgtttgaacaagattcctgtgctaagagaagaaaaactacctgtggtaggaattggaaagcatctgtgtggtatggcaacaggtacgtaaacatactgataatgtttacattaatgcattaagttttggcctaacctggccccaaccatttcagtggtctcttttgaatagatatcttatgtttacaactcaataatctttatagagcactggccctgtgctttattagatgcatagctttcctatttatctgctcatattggccattttgcaggatgaattaagagttttgtatgtaaatactgcatcacattagaccttaaagttctttgggttaaatttcaaccagaaaaggaaaataagaccatttatggaaactgtatgattccacctagaagctactgattttttagagtagttgcttagaaagaactcagaaacctcttctactaaaagactattgtgtttcaggattctggggaaaaagaaaaaaataaatgttagacaaa

SEQ ID NO: 292291 - DNA, 641 bp, Homo sapiens
aaatgattagtatgtgaggcaatacatgttaattagcttgatttagccattccacaatgtatacatatttgaaaacattatgttgtattaaaaccatacataaataatagtgtatattatttttattgccataaaaatcacaattacttttgtacaaacctaatatgtgataaatatatacaactatttgtcaattaacatgaaataggcagcatttttttctttcttggttgtgcataaaatagtcatacatataatagttgatgctatcttagatttcagacaccatatgtaggccttctctataccctgtttgaagctatagacccttgtttgtccaaagcagtatttgttcatatgtatttaagccagtacactggagagtttttgttaaacccttgggacctgattttgccaacttttcattatgtccttgtaaggtttccttaccttgttttgagattacagagacactgaagttatatctggtatctgtaagcaataaacttgatattttatttaaataaatgtatctcttaatttattaggaagaagatgctcggaaaagaatcctgtgtcctttagatccaaaacagtaagtgtggatcagatacgggtttttttttgtgctggaaacagta

SEQ ID NO: 292292 - DNA, 378 bp, Homo sapiens
atggaatgagaaatatataaaggaattaatcaaaaggcagcagttagtgatacacacattactctaccaaaaaacatttaatctgtgttatatacaaatcttatacctgctcttctccgtgactcttgtatgtatgtgtgcataaactgaaggccaaataattcccgttcctcttcttcatctgtgccttcactgggaggaagtgatactttcaatttcagtgggttgtctctgaagttgacaaacctagaagttcatcaaaaaacagtatttttataggtgtcatggaagtgtacatttatttccctggagaaaggtcaaatgataatatactaaattactcgtttttaactggtttcaataactgaacgacttggt

SEQ ID NO: 292293 - DNA, 2376 bp, Homo sapiens
cgacccgccacccgccgtagcccgcgcgcccctggcactcaatccccgccatgtgggggctcctgctcgccctggccgccttcgcgccggccgtcggcccggctctgggggcgcccaggaactcggtgctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttagctca

SEQ ID NO: 292294 - DNA, 2308 bp, Homo sapiens
gtcagattgcaggcctttgatgtcctgtgaaggctgttagatcctggtggtgtggcctgctgtgggctcacatgtcttcttgggctggcagacctttccatccggggtttcaccattcttcctttcccccatgctgtgcctctcggaccccaagggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtatgactgggtcacatcatacaaggtccagttcagcaatgacagtcggacctggtggggaagtaggaaccacagcagtgggatggacgcagtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttagctca

SEQ ID NO: 292295 - DNA, 295 bp, Homo sapiens
gtcagatataacccctatgacctgggaaggagggcccacccatctcaggtccccttcccaccttcccaccggggcacaacctgctgtgactgcgcttgtatgcccctgctgcctcctgatgtctcagccttctctcctgtggacccctaagctccatcccactttcccttattatggcgcccccccagtcctaccccttcctcccggctctgctgccgctcccctcctgtaccatgatgggatgccccctctgtgtgggccatcgctgactttttaagtctttccatggcacatg

SEQ ID NO: 292296 - DNA, 351 bp, Homo sapiens
gtatgtgcctgagggtggagttagccctggccccgtaacccccgccctgataagacagcctgcggttgcgtacagtgctggcgtctgttcccactctgaagtgtccctcagagaagggagggtagcgggaggatgggaccgcatcccgcctgcttaggcagcagtgtctgtggtccccttaggcatgaatgacttcagctacctacacaccaactgctttgaggtcactgtggagctgtcctgtgacaagttccctcacgagaatgaattgccccaggagtgggagaacaacaaagacgccctcctcacctacctggagcaggtcggatctgcgtcccggcccccagcctg

SEQ ID NO: 292297 - DNA, 3490 bp, Homo sapiens
taaggaacttgtgttataattttggtaaaagtataaacccactccctctggacaatacttagcgacagttgctaaagggggctcctttttaaatgtaaggactgaaatggatatacttctaataagtaaatttccaacacttatttgctccaccccctcccccctcccccctccccctttatcatgttaaacagcctttttgcttttcttattcctcctctcctggagagctgtgattagaaaccacacccacccttgaatgaagtgcttgaactgggggagggaggctggctacctgtgaacaaacattggcccaaataagggaaaataagtgttcctggactttggactagtttatagccagatattccaagagcagcaagacgttgctctctgccgtctctgaaaacaaaagagatgcataacatgcttgcacaaccttttaaaatatagatcagtatagtgctacctctatagttttcttcctcttctgagaaagcctgtatattgatgatcacacacacacacactttgcaattagagaatttggtttgctttactaatctgtttaactattccttcattcattatgaacgcttatattgatgaacatacacacagaggtttctttgctattagaaaattctgtttgctttcctaatctgtttaagcattcattcatgaagagtgtggggccattactggggaaggggggtgacagtgcctcagccagcaaaataccaatgaccaggattggggactaaatttaggaagctaaaatggccagagcaattaacatttgagaaaatcctgtctaggaaaacaacttgagtgtaggcatttgtaattcacttataccaaagttggaaaagtaaaatttaagcctaggacaatttttacttcatggatgttaaatagacaaatgcatagttcccagggggaatttaaacactttactggtgggaagaaacctagtattaaagttgtaaggactctcaaaaacttcacatttattaaaatgcactgctcttacccaatttatcctctgaattaaaatttcagtggattctacaaaacctcgtacaaatagctacagaactttgtgcctattttattcctctatttattcttctaggaagaagcctcttcctagaatcttgaaatagatcccttgactgaatgccaattcctctcctgtttttcaaatgagagaaccttttctgatcaccttgaccttttccctcatttcatatgtcttcccagaaagtagacagactgctctgctgccttcagtcattgtgcctcatttgggttgtccctccttctttgtggagaaatctggaaatgatgcacagtgtatccaaaagttgtgggatgaagtggatgaaagtgatttaattcatttttagaatttttttttgttttgttttagcaacatgctgaacaactaatttactttaaaaataagccagttaaaacaaaggacgctaagcccaagtggggggcaatattagtcaggatctttggggtctaattccagaccaactttcagaagcacttctttgtctctgttctcacctctgctgtccctctcttccctcatcccctaagagagacaaagataaaagcccacctgcatccctaagtcttactgagatcagccaccccaggggagagaaactggatctacttacagccaccccctgtttccatccatatacttacttcccccaatttgcatgtgattatggaaacaagtcatgctcatgaaagcaactgtaaaataaaaggttatggagtagttcagcaacttcttcacagccagctttgtggagctggggaggacttagggcccattggagtctcttatgtgtacagcttcagggctgtccctttcagtttgattttaagcaatgcctcacttcatagcttagggggtaaggattccattcaggtaggttgtctaaaggaactaatgggacctctcagtgaattagctgaccagattttaggaaatctttttaatttctatgattttccttctcacattttgaaatggtaaaattgactggaaataatttttcttggtgccttattggttttccttgcaaacctttctcatattttctcatgaccattgccagtgaccaaggcccatgtgtgtgttgtgtgtaattgtgggcatgtacaagcttaaataacgtgccgacagcactgtttcaaagttggtattcattaggctgttgcctcctgggctggagctgcgctaatcctgacaccggctgccaggagaaaacctcatggatcacacaccaaaccttaataacagcatccgtgacctgcactctccagtacagaatgggaaccccagagctaggaaatgtagttgtatattttaatgaactgctaccccagccaaagaagcttctttcacttttgtgctctacagaaagcccaaggggggtaggagggacagagctttgaataactgctttctaacactaaatgtggccaacaggacagagcacatcacacgtataggcaggtgtgagggacagtggctaagaattgcctgctccctctgcatgctctttcttgtttccaaagtccaatcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaaatgcattaaagtaatggtaaagacaataaaaagatgctgtagaaaaa

SEQ ID NO: 292298 - DNA, 3317 bp, Homo sapiens
gtcgtctacaactacttaatttcggggccgcgtcgacattcctcctctcctggagagctgtgattagaaaccacacccacccttgaatgaagtgcttgaactgggggagggaggctggctacctgtgaacaaacattggcccaaataagggaaaataagtgttcctggactttggactagtttatagccagatattccaagagcagcaagacgttgctctctgccgtctctgaaaacaaaagagatgcataacatgcttgcacaaccttttaaaatatagatcagtatagtgctacctctatagttttcttcctcttctgagaaagcctgtatattgatgatcacacacacacacactttgcaattagagaatttggtttgctttactaatctgtttaactattccttcattcattatgaacgcttatattgatgaacatacacacagaggtttctttgctattagaaaattctgtttgctttcctaatctgtttaagcattcattcatgaagagtgtggggccattactggggaaggggggtgacagtgcctcagccagcaaaataccaatgaccaggattggggactaaatttaggaagctaaaatggccagagcaattaacatttgagaaaatcctgtctaggaaaacaacttgagtgtaggcatttgtaattcacttataccaaagttggaaaagtaaaatttaagcctaggacaatttttacttcatggatgttaaatagacaaatgcatagttcccagggggaatttaaacactttactggtgggaagaaacctagtattaaagttgtaaggactctcaaaaacttcacatttattaaaatgcactgctcttacccaatttatcctctgaattaaaatttcagtggattctacaaaacctcgtacaaatagctacagaactttgtgcctattttattcctctatttattcttctaggaagaagcctcttcctagaatcttgaaatagatcccttgactgaatgccaattcctctcctgtttttcaaatgagagaaccttttctgatcaccttgaccttttccctcatttcatatgtcttcccagaaagtagacagactgctctgctgccttcagtcattgtgcctcatttgggttgtccctccttctttgtggagaaatctggaaatgatgcacagtgtatccaaaagttgtgggatgaagtggatgaaagtgatttaattcatttttagaatttttttttgttttgttttagcaacatgctgaacaactaatttactttaaaaataagccagttaaaacaaaggacgctaagcccaagtggggggcaatattagtcaggatctttggggtctaattccagaccaactttcagaagcacttctttgtctctgttctcacctctgctgtccctctcttccctcatcccctaagagagacaaagataaaagcccacctgcatccctaagtcttactgagatcagccaccccaggggagagaaactggatctacttacagccaccccctgtttccatccatatacttacttcccccaatttgcatgtgattatggaaacaagtcatgctcatgaaagcaactgtaaaataaaaggttatggagtagttcagcaacttcttcacagccagctttgtggagctggggaggacttagggcccattggagtctcttatgtgtacagcttcagggctgtccctttcagtttgattttaagcaatgcctcacttcatagcttagggggtaaggattccattcaggtaggttgtctaaaggaactaatgggacctctcagtgaattagctgaccagattttaggaaatctttttaatttctatgattttccttctcacattttgaaatggtaaaattgactggaaataatttttcttggtgccttattggttttccttgcaaacctttctcatattttctcatgaccattgccagtgaccaaggcccatgtgtgtgttgtgtgtaattgtgggcatgtacaagcttaaataacgtgccgacagcactgtttcaaagttggtattcattaggctgttgcctcctgggctggagctgcgctaatcctgacaccggctgccaggagaaaacctcatggatcacacaccaaaccttaataacagcatccgtgacctgcactctccagtacagaatgggaaccccagagctaggaaatgtagttgtatattttaatgaactgctaccccagccaaagaagcttctttcacttttgtgctctacagaaagcccaaggggggtaggagggacagagctttgaataactgctttctaacactaaatgtggccaacaggacagagcacatcacacgtataggcaggtgtgagggacagtggctaagaattgcctgctccctctgcatgctctttcttgtttccaaagtccaatcaagtgatcctgggaaacaaatctgtctggattgcggagggtggttctgaaagaactgccaagacgttaaagaagggtgaagagtaggcagaatataagtagctaacctgagtcaagactctcaaaagctagcagcctgatgacaataggatttatttcagccaggatagtgtctgtctgtgagtgcatcattttaagacagtatgacttcatgttgttacaaactatgtatagtatgtatgttttgtgggttgtatatatacataatatatattatatatatatatgagagatttggtgacttttgatacgggtttggtgcaggtgaatttattactgagccaaatgaggcacataccgagtcagtagttgaagtccagggcattcgatactgtttatgatttccatatatgtatagtgcctatcccatgctgtagtcactgttatgttaaatccagaagttacactagagccagcgatactttatttgtagacaatcaatttgaatccatatgttattactggcagatgatacatgattacagttctgaatctgtaacacttacaaaaggaaacccagagcagcttgatgagtttttgtttctgcttcgttcctgggagtcagtagaaacagcagttgtatgtggttatgttagtctcaagatacttaatttgttgaccttacttcagaaaaattttgtatgtattatatttgtgggaaggtaaaataatcatttgagatttttatcaaatatgaagattagttatttatgaaaaacaaagaaatgtctatttttctttgttcccaattaatgtagataaattttaaaatgcattaaagtaatggtaaagacaataaaaagatgctgtagaaaaa

SEQ ID NO: 292299 - DNA, 2635 bp, Homo sapiens
  misc_feature (344)..(344): n is a, c, g, or t
cttcattcactacacactctgagcctcatcatgcaaaaatacctaggagccaattttaaacatagaattcttttagctgttgattcacaaaatgtcttaggatgattaatttctaaaaatatcctcaaaggtatgagataataaggccacagcagtgttttcaatgcggcttccaagttaagcattattatgtggatgtagctatatctataccaacagagctataaatgcattcatttggggatgagtagtcttgatgtataattaatctctcattccttctgacagtactttttttcaaagttgaaaagtaagttgctttgttacttctgggacatgaaagnatcattcagtttcaattactgtcttaaggataaggaatactgcaagctgctccagatcctactgaagggaatgaaggtttaggaactttacccgagaactatagttattagggaaaacgataaccagaaggtccagaactgtcaagaattccatcatcagctgggaatttacaaatccaaatcagcagagaagtgcaataccagatagggacaaatgttttattccagttctgtgggagagaaaaggccagcttctgttgtgtacccagagtatagagcttcaaaacaaaatcagaaaacactattttaaaaactaattttccaaaaatcctgagatctctacttgaaaacataggtagcctaaagctttctgtgcacattaaactcatctgcttcatttatctgatttctaatcaatttgctggtattgttataacttcatgctttcataccttcgtgtttgttggtgggatctgcagccccagtggcacccgactcgctctcctctccctcaccgacgcccctgagtcgaaataatctgctaccacctattggcacagctgaagtggaacatgtgagcactgtggggccacaaagacagatggtatgtttctttcatattgcctctccatgtacttaccatacaacctaatgggcagtaattctgcaggatctgtgccctgatcttgatttatactgtgttttgtcaaaagtacaaacacagtgctaatttatgacgtggaattggagctgtttggcctgcacttaccatatctgccatggtcgatagggttttaactacataccacattacagatagttttcactgtttctgtaacttttgtctcctctgcagaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaaccta

SEQ ID NO: 292300 - DNA, 5554 bp, Homo sapiens
  misc_feature (4806)..(4806): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292301 - DNA, 2927 bp, Homo sapiens
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaaccta

SEQ ID NO: 292302 - DNA, 2279 bp, Homo sapiens
aggctagtgcgagccgggggttaattcggccgagggatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaaccta

SEQ ID NO: 292303 - DNA, 2271 bp, Homo sapiens
ctgccatctggggtgtggtgtggtatgtatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaaccta

SEQ ID NO: 292304 - DNA, 5618 bp, Homo sapiens
  misc_feature (4870)..(4870): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgcattaaactatcaaaatggtgccagctatgaccttgtgaccacagaggatgggacctctcttagatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292305 - DNA, 4954 bp, Homo sapiens
  misc_feature (4206)..(4206): n is a, c, g, or t
tgtttaggtgtggtattattttatttattggacgacttacagaaaagggttgtatttcagttatttatgcaaatagggctactgtggtcccaacagctctggctctgggcagcacaagaccctttgcccactcccagctttccaaagaacccaaacccaaatccctgccagctccaacttgctcagcactttaattgctacagtgggagccacactggtgccacaactgctcccaagcagcaatatttgtctttcagttgtctttctggtgacaatctttcagcacaaaagaatgcctcaaacagagtaggaatcagcccctgtggcaaatttttgggaagcactttggagtaggtgtccttcaggcttgccttcactggtgactaaaaaagtgactgtgatggcaggtggataatggacttgctttgccaaatgtccattctagtaaattatgtttatgattgaaataatgtcccacttttaagaacagattctcatgcctgagctagagtaccatctggaaactagtgttacttattgaaaggtttttatttttgctttatttccccctaaatgtagtttctagtctaaggctttttaccccgttagtcttgtcttccttgacatactgatctttacttcattgtgggtttctgatttggctactagagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292306 - DNA, 5476 bp, Homo sapiens
  misc_feature (4728)..(4728): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292307 - DNA, 5100 bp, Homo sapiens
  misc_feature (4352)..(4352): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292308 - DNA, 4881 bp, Homo sapiens
  misc_feature (4133)..(4133): n is a, c, g, or t
tgtttaggtgtggtattattttatttattggacgacttacagaaaagggttgtatttcagttatttatgcaaatagggctactgtggtcccaacagctctggctctgggcagcacaagaccctttgcccactcccagctttccaaagaacccaaacccaaatccctgccagctccaacttgctcagcactttaattgctacagtgggagccacactggtgccacaactgctcccaagcagcaatatttgtctttcagttgtctttctggtgacaatctttcagcacaaaagaatgcctcaaacagagtaggaatcagcccctgtggcaaatttttgggaagcactttggagtaggtgtccttcaggcttgccttcactggtgactaaaaaagtgactgtgatggcaggtggataatggacttgctttgccaaatgtccattctagtaaattatgtttatgattgaaataatgtcccacttttaagaacagattctcatgcctgagctagagtaccatctggaaactagtgttacttattgaaaggtttttatttttgctttatttccccctaaatgtagtttctagtctaaggctttttaccccgttagtcttgtcttccttgacatactgatctttacttcattgtgggtttctgatttggctactagagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttccccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292309 - DNA, 4456 bp, Homo sapiens
  misc_feature (3708)..(3708): n is a, c, g, or t
aaaaattaaagcatggggaaaaagtataaataaccaaattggaaatattaacttttggcaaagttggatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292310 - DNA, 4514 bp, Homo sapiens
  misc_feature (3766)..(3766): n is a, c, g, or t
aaaaattaaagcatggggaaaaagtataaataaccaaattggaaatattaacttttggcaaagttggaaaaccaaacaggtatcttctccaaccgatcaagagtactgtcttctttcaacacgtaatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292311 - DNA, 4548 bp, Homo sapiens
  misc_feature (3800)..(3800): n is a, c, g, or t
aaaaattaaagcatggggaaaaagtataaataaccaaattggaaatattaacttttggcaaagttggaaaaccaaacaggtatcttctccaaccgatcaagagtactgtcttctttcaacacgtaatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtgtaggtttcaaaagcagaacttctggaaaccgtgcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292312 - DNA, 4831 bp, Homo sapiens
  misc_feature (4083)..(4083): n is a, c, g, or t
cttcattcactacacactctgagcctcatcatgcaaaaatacctaggagccaattttaaacatagaattcttttagctgttgattcacaaaatgtcttaggatgattaatttctaaaaatatcctcaaaggtatgagataataaggccacagcagtgttttcaatgcggcttccaagttaagcattattatgtggatgtagctatatctataccaacagagctataaatgcattcatttggggatgagtagtcttgatgtataattaatctctcattccttctgacagtactttttttcaaagttgaaaatgtcttaaggataaggaatactgcaagctgctccagatcctactgaagggaatgaaggtttaggaactttacccgagaactatagttattagggaaaacgataaccagaaggtccagaactgtcaagaattccatcatcagctgggaatttacaaatccaaatcagcagagaagtgcaataccagatagggacaaatgttttattccagttctgtgggagagaaaaggccagcttctgttgtgtacccagagtatagagcttcaaaacaaaatcagaaaacactattttaaaaactaattttccaaaaatcctgagatctctacttgaaaacataggtagcctaaagctttctgtgcacattaaactcatctgcttcatttatctgatttctaatcaatttgctggtattgttataacttcatgctttcataccttcgtgtttgttggtgggatctgcagccccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttgctggatacacagtatcgtcgctcatgtgcagttgagtatcctcatcaggcccgacctggcaggggatctgcaggtcctcagttacatgggtctacaaaatctcaaagcggaggcagaccagtctctcgaaccaggcagggaccataaggcaaatgagaagaatctatcaggctgcaggaaacacgagatttcatgaagcagtattcagtcatcaagtgatgcagagcttgtatagaagatcgactagaaatcatcttcatgaagagtgattttggcacaagtgaccgaagaacaaaacaccatagcagccaaaaatgacatgagtgttgtttctatctccagttactgtctctttcagcagaaattaacctatcccattggaaaggcaagtttgtacccaaagatgcaacagtgaataatacccaaatcactgctcatgttatctcttaacaatgatcagttcaatcatataggatttgatgagctcacacatacacaaaaagcagcaaatcatcagtgacaatatcactggcttcagaatacttcagcctgtgttcatttctggagagttgtactcagttttaagtcattttgctgttgaaaatctgacctcatcaaatagatgtcattcctaaaactctctttagatgtcctaccctatcagcagattaaaatggaaggggtgtgtaactaaaaacataaatgttaagcattagtataaagtaacttctgtaataaattatatcgcatattttttcagataggacagctcaaccttacgatgcctacctgatgccaggtgatgcttattttcttcctaaagtaggttactggtcatatcttttttccaaatattaaatgcaccttgccagatattctcctgcagctctaaggaaaggaaatcaatttaaaaataatttgtagaatctactattgagccaccaaagtataattccctaaaagtttaagaaaccctggcaattaattcagcataaacatatcctataaacagcaggagaggttcagctttctgattttactgtggaccttttcctaagggcattcatgaatgcagcaacagttttaactatggcttacatttattttaaatttcactaaatacaaatcttgattgtcatgccagttttagatcttattaattttcagaatggataaattcaaataatcataaattacggtaactttttattataccaaggtgttctaatgccatcatatgaagacagatgcttcaaacaacctgcattaaattatatttttaataaaattaaaatctatttttaacctatttgtagtcacaaaccgaaaacgtgtcgtctttaccttagagctaaaggcttactttatgcatacggtatatttaatagtctacaaatcaaagatttaaacagtcccttaaaaattccatatattctcataccaactcatctacatagaaatgaaaatctctattgttctcacaaaccattaccatgagttcactataacaactggatcaatatggcttgcctttcaaagttaaagaatcagaaaggggcctgtaagaagtcatttagcccaattccctcaccctgtgtgttttccctcaaagccagtgcaatttttttttaaccaaaaaactggacatgtttaatacatacagtttgacaaatttggatttcactctttgttttgatgtagtaactcttttataaaagggaacagattcagacaagctcagtggcccaactgaagacattcagcaattaatggcaggacttcagtaatcagtggcaggactacaacatacatctcttcatgctagggaaaccaggctctctattataaagctgaccagggctattgttttccccttttctctcatcctaaacaccattcatatttttcctaggtcacattttagtgggatcatttacaaagcccccagaacttaatcatcatgttttaccttttttattgaattatatacacctcttacaaaaatgcttgaagtaatttaacacctgtacatcagtacaaaacctggctgagtaaaatgaagagaggatctattcaagatcattaagaccaaatgtaaactgggaagtatgtggaagatagctgtccagcaagtgtctggaaggtgttctagctgggtagagagcctattctaacagacacgcacatcgcagaaagcagcatgaacagaaccacatcctagataagagttctgtgtacagaagatccatggaggcaagtgctgtcaggaaggacactgcctccctccaccctcccaaatgtcaccaccaagttccttcaggtgagacctcacacaatgtcaagtgctttctaggaaatactaagatcaggttgagagattctgcttggtctagtcaatctgaaaaattcaggctggaaagacaccttttctcaagagctgaattgacttttgccttcaaatcctgcctgcaccttgcctacgatggcatcaatttacacctaaggacctttgaagagaaaaattccattatttcttttctttcttgagagcagattttttccctcctcctttggaagatttgcagtactttgcttccatctgagccagaaaattgtccatttccttttgccgatccttttgtctgctctgtttgagaagttaaaacacaagctttcacaacattatccatagacagaaagtacctagtggttgccaggggctggaaaagtggaataactactaatgggtatggagtttttttggaatggtgaaaatgtcctacaattggtgttaataattgtaaaactttgtaaatacacttaaaaccaccaaattgtacactttaaaaggacaaatagaaggtatgcggttatgtcttaaaagaagaaaacaaaatacaacattccaaagaaaatattagcagtaggaatcagatcattaaagatgtggcaacaaactgccaagtttacctgaatggctgccttcaggctatccacgccttcatcaagccccaactcctttctgctcatttctgcttctttggcctcttcctgagcctganacaggaactcacatgagactcagggccaccaggaaatgcttaaaatacatactctttcccaaaagcaaatctataattctgtttcaattttatgaatatatgaatagacaaaatgaatcgaattacataactatgtcattcattaaatggcaacaatgctgacagcaagcagtagatcctctgattccaattaccatttgttttttacccaattctatttgctagaggtagtaagtactctggcactcataaatcacatgatgataaaaaggaacatgaggccgggtatggtggctcacaactgtaatccccataccttgggaggccaaggtgggaggatcacttgaactcaggagttcaagacctgcctgggtaacatagtgagacctcagttctataaaaaagaaaagaaatgagcctggtgtggtggcatgtgcttgtagtcccagctactagggaggctgaggtgggaagatggcttcagtctgagagttcaggctgcaataagctgtgatcatgcctctgcactccagcctgggtgatggagatgccatctcttagaaaaaagagaaaaaaaaaaaaaaaaggcaaatgatgcaattgccaggatacaggtatttccaatttctctcctggaaacccaatttactccatgggactggtggtgccttgtgaacaaccccagtttaaaatgacttctccccagtagtcagaagaaccaacatcaataaactcagttttaacatct

SEQ ID NO: 292313 - DNA, 1855 bp, Homo sapiens
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaagatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaag

SEQ ID NO: 292314 - DNA, 1879 bp, Homo sapiens
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaag

SEQ ID NO: 292315 - DNA, 2075 bp, Homo sapiens
  misc_feature (2065)..(2065): n is a, c, g, or t
  misc_feature (2067)..(2071): n is a, c, g, or t
  misc_feature (2073)..(2073): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaactagtccctgatgcctattctttaatgccttatacagaaatcacaaatattctaagcaatttaacacttaagatatgtctgaccacaagcaagaatattaaatcccagtacacatcagataagcataactttattatgtaatcctgttcttctggntnnnnncnaa

SEQ ID NO: 292316 - DNA, 1942 bp, Homo sapiens
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagatagatgtaaatgaaaaaactcgagggggggcccgggacccaattcaccctataatgaattgg

SEQ ID NO: 292317 - DNA, 1932 bp, Homo sapiens
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagatgcggccgtcgccaccacttaaacaaacaaatcataaaaaaaaaggactctt

SEQ ID NO: 292318 - DNA, 1913 bp, Homo sapiens
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtgtaggtttcaaaagcagaacttctggaaaccgtgcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaag

SEQ ID NO: 292319 - DNA, 2327 bp, Homo sapiens
  misc_feature (2317)..(2317): n is a, c, g, or t
  misc_feature (2319)..(2323): n is a, c, g, or t
  misc_feature (2325)..(2325): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttcatccgatcagcacgagccattcatgtgctgaaacaccaagatctgtggaagaaatcctcagaggagcccgagtcccagtggcacccgactcgctctcctctccctcaccgacgcccctgagtcgaaataatctgctaccacctattggcacagctgaagtggaacatgtgagcactgtggggccacaaagacagatggtatgtttctttcatattgcctctccatgtacttaccatacaacctaatgggcagtaattctgcaggatctgtgccctgatcttgatttatactgtgttttgtcaaaagtacaaacacagtgctaatttatgacgtggaattggagctgtttggcctgcacttaccatatctgccatggtcgatagggttttaactacataccacattacagatagttttcactgtttctgtaacttttgtctcctctgcagaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaactagtccctgatgcctattctttaatgccttatacagaaatcacaaatattctaagcaatttaacacttaagatatgtctgaccacaagcaagaatattaaatcccagtacacatcagataagcataactttattatgtaatcctgttcttctggntnnnnncnaa

SEQ ID NO: 292320 - DNA, 1604 bp, Homo sapiens
  misc_feature (1594)..(1594): n is a, c, g, or t
  misc_feature (1596)..(1600): n is a, c, g, or t
  misc_feature (1602)..(1602): n is a, c, g, or t
cttcattcactacacactctgagcctcatcatgcaaaaatacctaggagccaattttaaacatagaattcttttagctgttgattcacaaaatgtcttaggatgattaatttctaaaaatatcctcaaaggtatgagataataaggccacagcagtgttttcaatgcggcttccaagttaagcattattatgtggatgtagctatatctataccaacagagctataaatgcattcatttggggatgagtagtcttgatgtataattaatctctcattccttctgacagtactttttttcaaagttgaaaatgtcttaaggataaggaatactgcaagctgctccagatcctactgaagggaatgaaggtttaggaactttacccgagaactatagttattagggaaaacgataaccagaaggtccagaactgtcaagaattccatcatcagctgggaatttacaaatccaaatcagcagagaagtgcaataccagatagggacaaatgttttattccagttctgtgggagagaaaaggccagcttctgttgtgtacccagagtatagagcttcaaaacaaaatcagaaaacactattttaaaaactaattttccaaaaatcctgagatctctacttgaaaacataggtagcctaaagctttctgtgcacattaaactcatctgcttcatttatctgatttctaatcaatttgctggtattgttataacttcatgctttcataccttcgtgtttgttggtgggatctgcagccccagtggcacccgactcgctctcctctccctcaccgacgcccctgagtcgaaataatctgctaccacctattggcacagctgaagtggaacatgtgagcactgtggggccacaaagacagatggtatgtttctttcatattgcctctccatgtacttaccatacaacctaatgggcagtaattctgcaggatctgtgccctgatcttgatttatactgtgttttgtcaaaagtacaaacacagtgctaatttatgacgtggaattggagctgtttggcctgcacttaccatatctgccatggtcgatagggttttaactacataccacattacagatagttttcactgtttctgtaacttttgtctcctctgcagaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaactagtccctgatgcctattctttaatgccttatacagaaatcacaaatattctaagcaatttaacacttaagatatgtctgaccacaagcaagaatattaaatcccagtacacatcagataagcataactttattatgtaatcctgttcttctggntnnnnncnaa

SEQ ID NO: 292321 - DNA, 2002 bp, Homo sapiens
  misc_feature (1992)..(1992): n is a, c, g, or t
  misc_feature (1994)..(1998): n is a, c, g, or t
  misc_feature (2000)..(2000): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgatgagtctctgtcaagcaagcagacatcagccaaatgtgaatgatctcttggttcatggaatgcctctacagccaagaaatctctccctaatggacaagctcctagatcttgatgacaagctacttatgaggcctgggtccagtaccatcctttcaactcgaaattggccaaatcgagctgtggagtttagtacatcatctctgtcatacacagtgcagtccaccaggagacgcaatccaccaccacgaactcttccccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaactagtccctgatgcctattctttaatgccttatacagaaatcacaaatattctaagcaatttaacacttaagatatgtctgaccacaagcaagaatattaaatcccagtacacatcagataagcataactttattatgtaatcctgttcttctggntnnnnncnaa

SEQ ID NO: 292322 - DNA, 1746 bp, Homo sapiens
  misc_feature (1736)..(1736): n is a, c, g, or t
  misc_feature (1738)..(1742): n is a, c, g, or t
  misc_feature (1744)..(1744): n is a, c, g, or t
ctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccacagagcttggagctgaaaggaataacaaaacatgctcttaaccatcatccccctccagagaagctggaggaaatttcccccaccagtgacagtcatgagaaagacacaagttcccaaagcaagtctgacatcacaagagaatcatcttttacatcagccgacactgggaattcactgtctgcttttccaagttatacaggcgcagggatatctactgaaggaagctcggacttctcctggggatatggaactcgatcaaaatgccactgaaaaagtccagacaatgttcacagccattgatgaactcttgtatgagcagaagttgagtgtgcataccaagagtctacaagaagagtgccaacagtggacagctagctttcctcacctcaggattctaggtaggcagataatcactccaagtgaaggttatagattgtatcctagatccccttctgctgtttccgcttcatatgaaacaaccttgtctcaagaaagagattctactatatttggtataaggggaaagaagttacatttttcatcttcttatgctcataaagcatcttccattgccaaatcctccagcttttgttctatggaaagagatgaggaagactctataatcgtctcagaaggaataattgaggaatacctagcattcgatcacatagatatagaagagggatttcatgggaagaaatcagaagcagctacagagaaacagaaattagggtatcctcccattgctccattttactgcatgaaagaagatgtccttgcttatgtgtttgacagtgtatggtgcaaggttgtgagctgtatggagcagttgacacgtagtcactgggaaggatttgcctctgatgatgagagtaatgttgcagttaccagacccgattcagaaagttcctgtgtgctgagtgaactacatcctttggtgttaccgcgagtgccacagtctaaggtgctgtacattacctcaaatccgcccagtggcacccgactcgctctcctctccctcaccgacgcccctgagtcgaaataatctgctaccacctattggcacagctgaagtggaacatgtgagcactgtggggccacaaagacagatgaaaccccatggcgactctagtcgagctcaaagtgcggtggtggatgaacctaactatcagcagccacaagaaaggctccttttgcccgactttttccccaggcccaacacaactcaatcatttttggtagagtgacgtacttcctagaatggtcttgatagttggggaaagaaaaggtggggggaataatagtttggcagacttaagattttatctagaggcttaacccagaataaaagttgagtttccaacaataaaaagtgttataaatacattttgttcaaattctaactagtccctgatgcctattctttaatgccttatacagaaatcacaaatattctaagcaatttaacacttaagatatgtctgaccacaagcaagaatattaaatcccagtacacatcagataagcataactttattatgtaatcctgttcttctggntnnnnncnaa

SEQ ID NO: 292323 - DNA, 460 bp, Homo sapiens
ccattgcatttttttcccattgtatttcctgctgagccatgttcactcacgtatcactcatgtgcacacagccctagggccagctaaatataagccaggcttctatacataataccactgagctagaactggaagcagattcttttggttttccaaagattgcctccttccctttcacttctcctgtgtcaaattacttctattttctatttattacttctatttggcctttgtcaaattaattctattttccatttttcctcaaatcaaagtgaattttcaggtaatacacagacaattttagaaaggcagccttcccttcagcatcatgaagtctttccttcttgcttctgttacagagaagagggatttcatgggaagaaatcagaagcagctacagagaaacagaaattagggtatcctcccattgctccattttactgcatgaaagaagatgtcc

SEQ ID NO: 292324 - DNA, 364 bp, Homo sapiens
aacagctgggctataggtttatcttttccatctccattctatggaagagatatacctgtagtaaggctctggattcacattttctcattcttaatcagtatcagactgtatactggacttttatgttgagccatcaaatgtgtccaaaatatatctagattttgtatgtatgccagtgaaggtacttaattgtgtctgtgtttcttcattttgaaggattctaggtaggcagataatcactccaagtgaaggttatagattgtatcctagatccccttctgctgtttccgcttcatatgaaacaaccttgtctcaagaaagagattctactatgtgagtattccattatgtaagtacttcaatg

SEQ ID NO: 292325 - DNA, 196 bp, Homo sapiens
acgcttatgatctgtggaggggacaaatcaagcacatgtgaatgcaacacactcaaaaacatgcccgcacgaagggtgatctgtgtgcatgttgtgtgtctgtatagtgttgtgggcattgtgtgcctacatcatgttgtatgcctataccgccttgttgtacacctatggctcagcctcctgttggagactgagg

SEQ ID NO: 292326 - DNA, 964 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292327 - DNA, 763 bp, Homo sapiens
gaagacagggctgcttcagtggaggttttttacttgtttttctgtttctcagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292328 - DNA, 1297 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacgaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292329 - DNA, 814 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292330 - DNA, 475 bp, Homo sapiens
ctttgcaggctgcagtcgctgtttgctttcctctgaaggagggcagaaagggcccacgtgcagggaagctcatagtatgggttccattgacccaggcaggcatgtgtggtcggcttgcttaggagaggtcttaagagggtcaggtgtgtgcctctgctagccaaattaagttcacgaagagacagatgaatgttgctcttactctatctttcatgtaatgtaggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292331 - DNA, 1001 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaacaaaaaaaaaaaaaaaaaaaaaagaaagaaaaaaaaaagagggggggggggaaaaaaaagaacggaagggggacaaaggtataacgctacaccaggtcttgggtacacgggggggcccaaaagaggagagctgcaataaaaaagcaaggaaggagacgcggataaaaacgcgcgagagtggggacacaagtgtcgaagggggaaacttgacggaagggcaaccatacatccgggggggcgacacatatgtgggacaatgtccgcaaggaattataaagcgctaaggaaatttacaaccttaacggcgtatacgtgtaaccacaaggataatacgctaaacacaattgtgcccagcagtcactacgtaacatact

SEQ ID NO: 292332 - DNA, 523 bp, Homo sapiens
ctttgcaggctgcagtcgctgtttgctttcctctgaaggagggcagaaagggcccacgtgcagggaagctcatagtatgggttccattgacccaggcaggcatgtgtcaatggaacccatactatgagcttccattgacccaggcaggcatgtgtggtcggcttgcttaggagaggtcttaagagggtcaggtgtgtgcctctgctagccaaattaagttcacgaagagacagatgaatgttgctcttactctatctttcatgtaatgtaggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292333 - DNA, 603 bp, Homo sapiens
agttcgacggagactctccagtatgaattatcttatgttcagtaagagttgaagatttcctaaaagcttgccacattcttcacatttgtagggtttctctccagtatgaattatcttatgtgtagtaagggttgaggattggctaaaagctttgccacattcttcacatttgtagggtttctctccagtgtgcatcctcttatgtgtagtaaggtgtgaaggctggctaaatgctttgccacattcttcacatttgtaggttgggatcttctctggatcaagcaatggtggtgaaaaatgtttcgcaagggcaaaaaacgacacagtagtagcagttcccaaagtagcgaaatcagtactaagagcaaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgctttttggtgctccgggggaagaatttttatgagagtctccgtcgaactgggtacgagctcgatcgtagatggccaaacaaa

SEQ ID NO: 292334 - DNA, 203 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcaatgctttttttttttttttttttttttttttttttttttttttttttttttttttttttttt

SEQ ID NO: 292335 - DNA, 1691 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292336 - DNA, 1580 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292337 - DNA, 1612 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292338 - DNA, 1093 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292339 - DNA, 2343 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292340 - DNA, 1262 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcgggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292341 - DNA, 1204 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292342 - DNA, 1191 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292343 - DNA, 2682 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgagaggcctgaggaagacgagatgtacacagaggtccactcagtgacaaacacagactgagaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292344 - DNA, 2853 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaacaattcagtcagcgataaagtgcacaaatgacaccgggaatgcgcctttgcgaccaggatctccatcaatgtggccaatctgaaatggagaaaagtgtaggttgttattaaaattccaaatgttggtggaaactttgaagagcattacatagagcgtttggtgaagaaaagcaagattggttcagaagactcttccgacaaggaattacttaggtaaaacatccaaatgatttttgtccgtttttcctcaccacatttcaaatagtgcaggcctctcccgtgtaaggagctcttcccagccatgtcccagatgttcgctcgtggggatggccacccccacctgttcttgggaggcacacaggtcagctgtctgaccactacttcccacttgccatttttcaatgaatgaatgaatgaatgaactgagtgtcacaagtttgtgagctgcaacgtcacctaaagtggcaaaggtataagttggccccatttcaatgagttaagtacttgtggaaggcttcactctatccacttatgttccctcttgggtagatacataaattatatccaaatatgatctcaagagtgtaaatgatgtaggcaaataaaaggctaaaaacagcaaa

SEQ ID NO: 292345 - DNA, 2354 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgagaggcctgaggaagacgagatgtacacagaggtccactcagtgacaaacacagactgagaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagccaaagcatgccacagaaggtacaactgcacgagcaaaacaaagcaagaatgacggaggaagagcagag

SEQ ID NO: 292346 - DNA, 1616 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292347 - DNA, 2193 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292348 - DNA, 658 bp, Homo sapiens
  misc_feature (21)..(22): n is a, c, g, or t
ccatcgagctcggcccacgtnnaagtgacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292349 - DNA, 1541 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292350 - DNA, 1337 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatatgttttgcacaggcatgctctctacttaatttaaaaaaaaaaatttt

SEQ ID NO: 292351 - DNA, 985 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcggtgagggtgagggtgagagggatctgtgcacctagcaccgtgcatggcacgtggtaggcgtttggtacatgggaatcgctgttggggtgtcacctccccagaaagttctcggcttcagtaagcgcgtcccctgccaggcgccctggcaatgcagaggagtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcagacgcgccatcgtgcgcctcgggatcctctagatcaac

SEQ ID NO: 292352 - DNA, 694 bp, Homo sapiens
aaaataaaaataacctttttgtaaatggggggaaatgtttcttctgcctctgggagagagactcttgcctggctaatgtgtaccccacattctttaaagggtttgggcttgcgatggccagatactcaaagtgactagtcagacttaagactattatgtaattttaatctttatcatggaatttatttttactttaaagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaac

SEQ ID NO: 292353 - DNA, 1577 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggtgcgtagtttctctgaaaagcatcacccaggtcagaatgaaaggaaactctctgtgcagaccgctgtatgtgggacctttgaagacagtcaaatagtgttcaattctatagggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292354 - DNA, 1280 bp, Homo sapiens
aggcgcggcccggcggacgtgggcaggagggctggaaaagccggcgctggagcgggaacgggagtagctgcctgggcgccaaaggccgcggcactcccacgcggaccccgaagtccgcaacccggggatgggcccgcggctgcgaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292355 - DNA, 1196 bp, Homo sapiens
aaaataaaaataacctttttgtaaatggggggaaatgtttcttctgcctctgggagagagactcttgcctggctaatgtgtaccccacattctttaaagggtttgggcttgcgatggccagatactcaaagtgactagtcagacttaagactattatgtaattttaatctttatcatggaatttatttttactttaaagcaagatggaaagttgccttttgttcctccggaggaagaatttattatgggagtttccaagtatggcataaaagtatcaacatcagatcaatatgaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacagaagcctaggtgtcacagaggtccactcagtgacaaacacacactgaaggcctgaggaagacgagatgtcacagaggtccactcagtgacaaacacacactgaaggcctgaggaagacgagatgtcacagaggtccactcagtgacaaacacacactgaaggcctgaggaagacgagatgtcacagaggtccactcagtgacacacactgaaggcctgaggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaccatgtccatttaaaagt

SEQ ID NO: 292356 - DNA, 581 bp, Homo sapiens
ggctcgggcttggttccgggcggggccgcgctcccggggcgcgggtggaggagcttggaaccgcagatcgggcgtgggcttgcggactgcagcttcccgagccgctgtcgccccggaggggcggcaaggcgggcggccgcgggccgtttccttgcctcttcctctgccccgcttcggccgcctcccgcctctcagggtcggggttgtctgtccccttcgctgtcacatcctccgcacccagcgcttggaaggtgctccatcacggtgacagacaggtgccaagcaggctggcgtctgggaggaacttcggagccggctctccctaggccccgagcttggccgcatccgtccttactctggtgaccctgggcaggtcactgactcttcgggcgctttggcatcctcgtttgaaaggggctgttatcctgcagccttgctggtcgggtgcgtagtttctctgaaaagcatcacccaggtcagaatgaaaggaaactctctgtgcagaccgctgtatgtgggacctttgaagacagtcaaatagtgttcaattctatagtaagcagattttcttgttctctctg

SEQ ID NO: 292357 - DNA, 475 bp, Homo sapiens
gaggccaagatggtaggatcgcttgagcccaggagttcaagaccagcctgggcaacgtagtgagaccctctctctaaggggaaaaaaaatggtgaagagggagaaagaaccaaaagtaaataccatgcgtcataaaggtaatcattatgtagtaaccttttctttactgtttgttttgaagggaaggttaatatatttattcctattattgagacctttgtatactatatttagtataccatgagtcactgaggaaaaggttagtgaaattttaagttcttccccattacataaaaatattgtgtattataaaatttgtaattagtggttatgttctaatgacagtctggtttttatttgggaagggactgaggatactctgtaatgcagatatttcttcttaagtcttaccacttttctttcatcttcaggacaaagcaacaataattcagatacctgtgcagaatttcgaata

SEQ ID NO: 292358 - DNA, 205 bp, Homo sapiens
gtcaccgagctccgcctttgaccagcgtgcagctgggagagtgagatcagagaccacagcagatcgtggcgctgtgatcagggggtacactcaagctgtgggtcccttaccccagccttgagatcccaggaaggcctgcagcctgaaacgggccttgaaaggtaagaagtagccaagtgcctgacaggtgaaggacgtcccgggc

SEQ ID NO: 292359 - DNA, 1172 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaa

SEQ ID NO: 292360 - DNA, 1118 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaag

SEQ ID NO: 292361 - DNA, 676 bp, Homo sapiens
ctttacaaaatcatttaacctttatgacaggagctactatggtgctcattccacagatgaggtgctgaggtttagtgaactgaatagcttgttcacagacagttggagacagagactcagtttgcccatacaaagataattttaaccaatagcattttacaatagaatatcataatacctatgaattctaaaaacattttattcaaatctctcttttaatattagcacctcttcaacctcttcttgactctaccaccaaatttatcttcctaatttctcttaccctgtaaatttctgtgtgtgtgtgtgtgtgtgtgtgtgtgtgtgtgtgtggagagagagagagagagatagagacagggaaagagtgagtttaccaaaaaaataagataggaaggttgtcgtaacatcttccatttctcaattctgaagtccccattttcatccctgggagagttgttctaggatagggtagctaaaggaacagagaaaatcagagtaatggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaa

SEQ ID NO: 292362 - DNA, 1708 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaa

SEQ ID NO: 292363 - DNA, 1654 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaag

SEQ ID NO: 292364 - DNA, 2169 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcaggtaatttctagaaggcttgctttgttccattgatactgaagattattcatgaggccagtcttctgagatttctgtcatttctctcatgccaggtcaccaaccagtgtggaggctaaaagcgggcctctttggggattccaggtggaagtgttggacatctgtagtattcctggtctcaaatcatcctgatattcttcattttgttattcacattggactagggcaaggaaatgagttctgcaggaacaaagatcaccacaactggctccccttcaactatgttagatggcaacttgccttcagtatggtgaaacacatcagttaagactggggttgtgcatggcaggactttctacaaggacacccagtctccttaataaacatgagatgctctctttccagaagttctcttgcctgacacagcataggaagatgctgaacggccacacagtgacccattgagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaa

SEQ ID NO: 292365 - DNA, 1366 bp, Homo sapiens
ctttacaaaatcatttaacctttatgacaggagctactatggtgctcattccacagatgaggtgctgaggtttagtgaactgaatagcttgttcacagacagttggagacagagactcagtttgcccatacaaagataattttaaccaatagcattttacaatagaatatcataatacctatgaattctaaaaacattttattcaaatctctcttttaatattagcacctcttcaacctcttcttgactctaccaccaaatttatcttcctaatttctcttaccctgtaaatttctgtgtgtgtgtgtgtgtgtgtgtgtgtgtgtgtgtgtggagagagagagagagagatagagacagggaaagagtgagtttaccaaaaaaataagataggaaggttgtcgtaacatcttccatttctcaattctgaagtccccattttcatccctgggagagttgttctaggatagggtagctaaaggaacagagaaaatcagagtaatggaattagctaaaagggaaagtggtgacctgaagaccaaacactaaagaaggggccagtgaatggcaaagaaagtgcagagcaaaaaacatgcaggtagatggggtcctagttagtgaaggcccacaggctggagggtaaacccatgcaagggtcaagtttaatacagtgaaaatataagatgggagacctaccacagagaaccaacacttggcatgtttctgatgacagtgtttagattgcagtggttctaaaaattaagtgattttggaattggcattccatgtcattttaaaagataaatgataaagtaaatgttttattcagatctctctctccctccccacccacctttttccctccattcttctgtttttaatggggacgtttaaaatccaatctcacattaattttttcttaagtgtaaataatgggaaaacttcacttcgagagggggctcctcagtagacctccataatttcctggcttttactgccagttagtcatcaggaatagccatggctaagagagtaccaactgggcaagccagtgaattataccagtgcatctcagatttattgatttgtttaacttttgttttttgttcttttttttttttcagagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaa

SEQ ID NO: 292366 - DNA, 2115 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcaggtaatttctagaaggcttgctttgttccattgatactgaagattattcatgaggccagtcttctgagatttctgtcatttctctcatgccaggtcaccaaccagtgtggaggctaaaagcgggcctctttggggattccaggtggaagtgttggacatctgtagtattcctggtctcaaatcatcctgatattcttcattttgttattcacattggactagggcaaggaaatgagttctgcaggaacaaagatcaccacaactggctccccttcaactatgttagatggcaacttgccttcagtatggtgaaacacatcagttaagactggggttgtgcatggcaggactttctacaaggacacccagtctccttaataaacatgagatgctctctttccagaagttctcttgcctgacacagcataggaagatgctgaacggccacacagtgacccattgagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaag

SEQ ID NO: 292367 - DNA, 1744 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtagcacaatattttaactatgtcctttaaaaagtttctccacagacactacccaaagcagtccttcactacagtggcagacagacctgaaaattttcatctgaagcagcagagtgaactgcagagtcagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaaggggaaaaaaatcacaaaaaaacaacacgaataact

SEQ ID NO: 292368 - DNA, 1312 bp, Homo sapiens
ctttacaaaatcatttaacctttatgacaggagctactatggtgctcattccacagatgaggtgctgaggtttagtgaactgaatagcttgttcacagacagttggagacagagactcagtttgcccatacaaagataattttaaccaatagcattttacaatagaatatcataatacctatgaattctaaaaacattttattcaaatctctcttttaatattagcacctcttcaacctcttcttgactctaccaccaaatttatcttcctaatttctcttaccctgtaaatttctgtgtgtgtgtgtgtgtgtgtgtgtgtgtgtgtgtgtggagagagagagagagagatagagacagggaaagagtgagtttaccaaaaaaataagataggaaggttgtcgtaacatcttccatttctcaattctgaagtccccattttcatccctgggagagttgttctaggatagggtagctaaaggaacagagaaaatcagagtaatggaattagctaaaagggaaagtggtgacctgaagaccaaacactaaagaaggggccagtgaatggcaaagaaagtgcagagcaaaaaacatgcaggtagatggggtcctagttagtgaaggcccacaggctggagggtaaacccatgcaagggtcaagtttaatacagtgaaaatataagatgggagacctaccacagagaaccaacacttggcatgtttctgatgacagtgtttagattgcagtggttctaaaaattaagtgattttggaattggcattccatgtcattttaaaagataaatgataaagtaaatgttttattcagatctctctctccctccccacccacctttttccctccattcttctgtttttaatggggacgtttaaaatccaatctcacattaattttttcttaagtgtaaataatgggaaaacttcacttcgagagggggctcctcagtagacctccataatttcctggcttttactgccagttagtcatcaggaatagccatggctaagagagtaccaactgggcaagccagtgaattataccagtgcatctcagatttattgatttgtttaacttttgttttttgttcttttttttttttcagagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaag

SEQ ID NO: 292369 - DNA, 1393 bp, Homo sapiens
  misc_feature (1383)..(1383): n is a, c, g, or t
ctttacaaaatcatttaacctttatgacaggagctactatggtgctcattccacagatgaggtgctgaggtttagtgaactgaatagcttgttcacagacagttggagacagagactcagtttgcccatacaaagataattttaaccaatagcattttacaatagaatatcataatacctatgaattctaaaaacattttattcaaatctctcttttaatattagcacctcttcaacctcttcttgactctaccaccaaatttatcttcctaatttctcttaccctgtaaatttctgtgtgtgtgtgtgtgtgtgtgtgtgtgtgtgtgtgtggagagagagagagagagatagagacagggaaagagtgagtttaccaaaaaaataagataggaaggttgtcgtaacatcttccatttctcaattctgaagtccccattttcatccctgggagagttgttctaggatagggtagctaaaggaacagagaaaatcagagtaatggaattagctaaaagggaaagtggtgacctgaagaccaaacactaaagaaggggccagtgaatggcaaagaaagtgcagagcaaaaaacatgcaggtagatggggtcctagttagtgaaggcccacaggctggagggtaaacccatgcaagggtcaagtttaatacagtgaaaatataagatgggagacctaccacagagaaccaacacttggcatgtttctgatgacagtgtttagattgcagtggttctaaaaattaagtgattttggaattggcattccatgtcattttaaaagataaatgataaagtaaatgttttattcagatctctctctccctccccacccacctttttccctccattcttctgtttttaatggggacgtttaaaatccaatctcacattaattttttcttaagtgtaaataatgggaaaacttcacttcgagagggggctcctcagtagacctccataatttcctggcttttactgccagttagtcatcaggaatagccatggctaagagagtaccaactgggcaagccagtgaattataccagtgcatctcagatttattgatttgtttaacttttgttttttgttcttttttttttttcagagagatagaatctcactatgttgaccaggctggtcttgaactcttggcacccaagcgatccttttgcctggaatcccaaagtgtcagatttactgaagaatatttcattgtaattactttttatactttataggtcaagagctctgttttaaagacaaaatttattgaatatactttttcaaacaaagtttcatgttctaatcattgtctgatttcagcattaaatgaaacacagtaaagaaggggggaggggaaaaanaaaagataac

SEQ ID NO: 292370 - DNA, 1455 bp, Homo sapiens
tttttctgtgtgtagcaattatgaatgggattatgttcttcatttgactctctgctttactgctaggaatttttgcacattgattttgtatgctaagactttgctaaagtttatcagcagaaggagctttggggctaagactatggggttttctagatatagaatcatgtcatctgtaaacagagacagtttgacttcctgtctattcctctcttccctcctctatttggatgcccttccagttttgcacattcagtgtaatgttggctgtgggtttgccatggctagctctcatcattttggcacttccgactagaagtgcgagaggggccagtgttgttgttacctgaaaggtaagtgcagcccacaaaaatgcagtgaagaagaagatatatgcatatgtttaagttaatacaattgagatacatttagcagacagaatcaatagagttgatgagtgactgactggatgtgtggggagtttatatcactcccaggtttttgacttgggcaaccgggcactcaagaaggaaaaagaggatccagggagaggaacttttctgaggactggggtagggctgaacagctgcattcgagactggtggagggtgggctgggcatgggatgcacaaatggaaattccactgggtctgcagctcacacataggcatgaccagcatagagatagagaggccccagtgctgctgagtaactgtgattccccaggtgatggcatcagctgagaagggaaggaagcccatgtgaggacactgaagaaggagtgagcagacaataagaagcccacagaagacagagaaggaacaactagagggagaagccaaggcaggcatgtgtgataacatataggaactgagggagaggacatttcaagatggaggggatgccatacaacaggactatgtgatggtttttggctgtgtccataggaagtcacaacaggcaagggaaagaaaccagaacccagtcatggagttaagaagtgagtcagagaggagatgggtagggacagtgaggtaaggcctctttctaaggaagtttggctgaaggatagactagctggacacatgctggctgtgtggggtagagggaggaatgatggagggtaggagagccttgagcctgcgagaagagtctcctagaatagagaagctgaggttaaagttgtggaagacagtggggataactgagtgacagataatcaggagaagaaaaggagatccagaatcatgacagagagatgacctttgccaagagcacagccatctttcactgtcacagagaggtaggacaaaacgattggtgttcaagaattggtttgtaggctaccagctgctgtctgatggtgtctcctgtgaagatgtcaatgaatgcatcactgggcagccactagctggccggcttggagaatccttgcatcaacactatgtggtctct

SEQ ID NO: 292371 - DNA, 473 bp, Homo sapiens
atgcagtggcacgatctcggcttactgcctcccgagttcaagctattctcctgcctcagcttcccaagtagctggaattacaggcatgcaccaccacgcccagctaatttttttatttttagtagagacagggtttcaccatattggccaggctggtctcagactcctgacctgaagtgatctgcccacctcggcctcttgaagtgctgggattacaggcatgagccatcgcgctcggctgattctccctagaatccactcttagcagagtgtccaagatgttcctaccaagagcagtggtggtacctggcagctgcccagtgactgactgggatgaagtatgggcaatatggcccaggcctgggctgttagatggtggggtgcaggggaggcaggggcaggggcagataccctacccctcaacccattaagagggaaaccaaagtccgactacccaccaggcagatgtgttc

SEQ ID NO: 292372 - DNA, 668 bp, Homo sapiens
agcgcctgccagtgacgtcgtgggctgcagcgcagcagcacccaacgcatctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292373 - DNA, 901 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaccagaaacacacaacgagaaaaaaaaaaaaacaaagaaaaaaacgacacagacaggagaaagaaacagagccagcgcgcgacacacggagcgacaaaagcgagcgacgagggcagagcgagagagtagagcgagaaacacgaagagacaggagaaagaggagaggagcgaccggcacacgagcgaccaaaaaaagaagaggagacacac

SEQ ID NO: 292374 - DNA, 780 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292375 - DNA, 907 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttggcgcctcgtgtgggccgggaacagaggcgggaggcgctgtaccctcccggtggagtcgggagggagggaggcagggaaggggacagggggctgcacctgtaataagcccttgtccccatgcagtctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292376 - DNA, 1425 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttggcgcctcgtgtgggccgggaacagaggcgggaggcgctgtaccctcccggtggagtcgggagggagggaggcagggaaggggacagggggctgcacctgtaataagcccttgtccccatgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292377 - DNA, 1298 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292378 - DNA, 1168 bp, Homo sapiens
ggtgggctgcagcgcagcagcacccaacgcatctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292379 - DNA, 818 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292380 - DNA, 1284 bp, Homo sapiens
ggtgggctgcagcgcagcagcacccaacgcatctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggtgagtggcgtggtgattacatgtgtcttggaagcatcctgggctgggatttgataagaaaccattaggtggaagaaccttccttttaaaaaagatctcttcattctctgcctagcgttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292381 - DNA, 1062 bp, Homo sapiens
agcgcctgccagtgacgtcgtgggctgcagcgcagcagcacccaacgcaaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292382 - DNA, 751 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggcggttctgagaagtccaagggttgctgggagaggttggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292383 - DNA, 713 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttgcacgccagggcctgtactgaccacctccacgtgccactggggctgtaaggaggaatggcggccgtgggcagcctgcttggccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292384 - DNA, 1648 bp, Homo sapiens
ggtgggctgcagcgcagcagcacccaacgcatctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggtgagtggcgtggtgattacatgtgtcttggaagcatcctgggctgggatttgataagaaaccattaggtggaagaaccttccttttaaaaaagatctcttcattctctgcctagcgttgcacgccagggcctgtactgaccacctccacgtgccactggggctgtaaggaggaatggcggccgtgggcagcctgcttgggtaagcatggacttttaggtccctggggattactgtcaggggccaccccagggaacccctctcttcagcaggaaaccgccattctaatcctccctagtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctggtaatgtctcctgtggcccggcagtgccaatcacagccagcctcagtcatgttggcactctgctgcagcactgtcggctgaccagagcttgaacatttatctgcagccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292385 - DNA, 1662 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttgggtaagcatggacttttaggtccctggggattactgtcaggggccaccccagggaacccctctcttcagcaggaaaccgccattctaatcctccctagtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctggtaatgtctcctgtggcccggcagtgccaatcacagccagcctcagtcatgttggcactctgctgcagcactgtcggctgaccagagcttgaacatttatctgcagccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292386 - DNA, 1542 bp, Homo sapiens
ggtgggctgcagcgcagcagcacccaacgcatctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggtgagtggcgtggtgattacatgtgtcttggaagcatcctgggctgggatttgataagaaaccattaggtggaagaaccttccttttaaaaaagatctcttcattctctgcctagcgttgcacgccagggcctgtactgaccacctccacgtgccactggggctgtaaggaggaatggcggccgtgggcagcctgcttgggtaagcatggacttttaggtccctggggattactgtcaggggccaccccagggaacccctctcttcagcaggaaaccgccattctaatcctccctagtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292387 - DNA, 1532 bp, Homo sapiens
ggtgggctgcagcgcagcagcacccaacgcatctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttgggtaagcatggacttttaggtccctggggattactgtcaggggccaccccagggaacccctctcttcagcaggaaaccgccattctaatcctccctagtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctggtaatgtctcctgtggcccggcagtgccaatcacagccagcctcagtcatgttggcactctgctgcagcactgtcggctgaccagagcttgaacatttatctgcagccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292388 - DNA, 1586 bp, Homo sapiens
agcgcctgccagtgacgtcgtgggctgcagcgcagcagcacccaacgcagtgagtaccttgatctcctgcgtggcctcgtccctggtcttagttccaccgggcagcgggagtcaggaccgcctgtcctcagacccctccgcagcgactgtggcggccgcaggttggcgcctcgtgtgggccgggaacagaggcgggaggcgctgtaccctcccggtggagtcgggagggagggaggcagggaaggggacagggggctgcacctgtaataagcccttgtccccatgcagtctagcaggaaaggagagggagctttccccgaagaccctcctggaccagccccaggctcctgtgctggtgaggccgagggagagggatgtgggcataggacacgtagcaggatttccattttagaggcagccggacctgtcttcaggtcccttccttggtgagagacaggggtacgccagaggaagctgggcgctcggcctctgtgcagcctcatctcctggaatctgagtattgaaaactgggcttttacttcgcacacctcagcacagactcccatgggaatccaggtcacagcaaagcagccctgggcctccattctcctttaagcaagcatgacaatcctcacttcactgagtttttattaaaactagcaatgaccttagaaagcaaggcatgacctcagctccacttttgaggctgcagtccattcagagaggtttcgcagactcggtaacggccagaacagacagcctgggccctgccgcaggctgactcagaatctttgggagtagtgaccaacttctgcttttggaaaaacctctacaggcggttctgagaagtccaagggttgctgggagaggttggttgcacgccagggcctgtactgaccacctccacgtgccactggggctgtaaggaggaatggcggccgtgggcagcctgcttggtccttgctattgtccactgtcccctgtgctggaagctttgtgcccttgctcagcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292389 - DNA, 776 bp, Homo sapiens
agcgcctgccagtgacgtcgtgggctgcagcgcagcagcacccaacgcatctagcaggaaaggagagggagctttccccgaagaccctcctggaccagccccaggctcctgtgctggttgcacgccagggcctgtactgaccacctccacgtgccactggggctgtaaggaggaatggcggccgtgggcagcctgcttggcctggcagcctcttcctggctagggggccagaacgcctctgaccacagcctgtggctcctgaggaagccccgaggctcatcctgccccggcacgggtcaccagctctgccggctgaggcagagcaccgtgaaggccaccggacctgcactccgccgcctgcacacatcctcctggcgagctgacagcagcagggcctcactcactcgtgtgcaccgccaggcttatgcacgactctaccccgtgctgctggtgaagcaggatggctccaccatccacatccgctacagggagccacggcgcatgctggcgatgcccatagatctggacaccctgtctcctgaggagcgccgggccaggctgcggaagcgtgaggctcagctccagtcgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctgcaaaaaaaaaaaaaaacaaaaaaaaaaaaaaaaaa

SEQ ID NO: 292390 - DNA, 402 bp, Homo sapiens
gcggccgctgggagcggggttcgatcccgtgatgccgtcgtgggtgccggccagagaagagctccggaggccggggcggccggcgggcgtgcgaatgtcatctttcccaacaagttgttcccagcagaatcctctctcctggcacaaaacaagcagatgaagagcagccctgagaggtagacacagcggagatttttttcacccgcattgtacagaagagaaaatgaagctttgcccaacctgcaggagatcccctcaccttgcaaaagagccaagctgtggctaaactgggatcttcagtccctggaccatttagcttgactaagagaacaggaatggaggccaaaagatctacaaaatgctcacacagagaagatgacagcttctacaaataaatgtcaa

SEQ ID NO: 292391 - DNA, 787 bp, Homo sapiens
  misc_feature (9)..(9): n is a, c, g, or t
  misc_feature (13)..(13): n is a, c, g, or t
  misc_feature (15)..(15): n is a, c, g, or t
  misc_feature (25)..(25): n is a, c, g, or t
gacctcggnccantnttgacatgangacagtatgaaatttcatacagtttcctaacttgagaaaacatggtgatgcaattcctccaaccaggagggatttatggacagcggtggctacgtcctaatctgcccagaatacaggatgactaaacaaattggcaaacggacgcagctttctctctctctaagaaaagtctgctgagaaccctcgttcccactctgtttctgcctccaagaagaaaagcctaaaactcactttcttccggactctttcaaggaagctgattaaaagaagctcctaaaccagaggtgcagacaaggtgatgatgtggctctcagaggaaggtgtgctacctacaaccctgctggcttcatggaagaatatgcttctcaaatgcaaatccaatcaagttatctccctgcttaaatccaaactcgctcatgtggcccacaaagcctaccttgcctgcctctctctaacctcacccaaaacacacttccattgctctctaggttccagcaccctgaccttttggtctgcactgtgccaggctccctccagccctgaagcctttgcacatgctgttcctcctgtctggaaaggctctcccatcttgtctattcgttctccaggctcaagtgactcttcctgagagccttctctgaccccagtccaggtcaagttcctctgtcacatgcctgaccctgcatccctccttgacagcacttatatcagcttgtaacacatttttgtgtgattattttgttaatgtcagcctctcccaca

SEQ ID NO: 292392 - DNA, 490 bp, Homo sapiens
cgctgctcacctcccgcagcagcaacagtgcccggggtcccgcagcgtaagttctgccggcaagtcggatcccctcacaggtccgccgctgcgttcatacacaagcgacttccgttccgccgctacttcaggccgggtcatgctaacggaagtgcttcctttttacagtccgggtggacccaaagctccgtggcggtgctgaactttagggcagccactagccacggacttaagcggcaattgagctcctcaaagtgggtgagtgcaaatcaaatgtgcgctaaatgtcagatacactggatgtggaagaagaaatgtcaaatagtgtcaaatagttcatatatataatgtttatattgattatgtgctgcaataattgttgggatatattgggttaaataagtacatttgttgaattagttttttttatttgtagctatggtggtagaaatatttgaattaagttcacctgttgtttctttttactttt

SEQ ID NO: 292393 - DNA, 808 bp, Homo sapiens
cgctgctcacctcccgcagcagcaacagtgcccggggtcccgcagcgtaagttctgccggcaagtcggatcccctcacaggtccgccgctgcgttcatacacaagcgacttccgttccgccgctacttcaggccgggtcatgctaacggaagtgcttcctttttacagtccgggtggacccaaagctccgtggcggtgctgaactttagggcagccactagccacggacttaagcggcaattgagctcctcaaagtggtgccctaaagaaggaagcttgaatgcccctggggataagaggcttattaccagagggacactcccagatcctcccagcacacctgtagacacctcctgcacaccctcggcggcccggtgacagccatccacaagctggcgggtccaggcagccagctcctgcggtgactccacgctgaacagccagacaaggttctctctggaggcagaaactgttggggtcagctctgtgccctctgaaccatgcagcacaaggcataagtgtcagcgaatgagtggctaatggggaccttagtattgacctgggcttggatggcagtcgcccacgacctcgcactagcctcatccttggccctcaggaagagggtgtcttgaccatctgccgagcagatctccagatacctgcaggcacaaatgggtggagacaaggacctgaccattaggctgcagctgcccaaccctggcccaagaaaccccacccaccaccaaaccaggagaaaccagggggatgtccgtgagagaatcaggagcaaccctcactgctgggctcc

SEQ ID NO: 292394 - DNA, 803 bp, Homo sapiens
gctgcgtggggatgtctcctttgtttagatggcgtcagaggcagagcaggtgtcagtgaaggggagtgagcacaggaccagctgtctcccaagaggctgaggagctggcccaaggctttgggggctggatttgtgcctcacccagctcctgccttgtggctgtctccacagtcctccctactgactggctttctgcctttgttttctcagccatgatgaggagcagccctgggccaggtgccacggtcagtatgagaggctccaggatcaggctagagaaccacgcgaaccaggtctggggagctatctgtgggaaaggtcagggcctgtttttctcctaagctgctggctgttcaagggacctacctccttgtcccttcccagtcacaggtccaaggggcaaatagcgaattcccatggaggagaatcactgcactccaagtggacgtggctggtaggaagcttccctcatgctgcccttctggaaggtgccttcccctgtgctgacgtctgcaggatgcgtgttacaccccatttggatatcacatcttgagctgtgggaaaggagagcagggcttccctctctgaaccccatgcctggcagggtaagtgcccagggagcacctgctgcctggatggggagtctgcgccacttctgctagcacagcagcatcccgtacctgaaagtgaaacgtctgaataggctcgccgtcctgatcgtaagtgaacttgccaaggagtgtcccctcctgctgcaggtcttcgtcaaacccctgcaaagagagcggagggaagtggggagg

SEQ ID NO: 292395 - DNA, 514 bp, Homo sapiens
gctgcgtggggatgtctcctttgtttagatggcgtcagaggcagagcaggtgtcagtgaaggggagtgagcacaggaccagctgtctcccaagaggctgaggagctggcccaaggctttgggggctggatttgtgcctcacccagctcctgccttgtggctgtctccacagtcctccctactgactggctttctgcctttgttttctcagccatgatgaggagcagccctgggccaggtgccacggtcagtatgagaggctccaggatcaggctagagaaccacgcgaaccaggtctggggagctatctgtgggaaaggtcagggcctgtttttctcctaagctgctggctgttcaagggacctacctccttgtcccttcccagtcacaggtccaaggggcaaatagcgaattcccatggaggagaatcactgcactccaagtggacgtggctggtaggatgggatacagacgcgacggcatagagcgaaggaagagaggactcgcggagcctt

SEQ ID NO: 292396 - DNA, 709 bp, Homo sapiens
gctgcgtggggatgtctcctttgtttagatggcgtcagaggcagagcaggtgtcagtgaaggggagtgagcacaggaccagctgtctcccaagaggctgaggagctggcccaaggctttgggggctggatttgtgcctcacccagctcctgccttgtggctgtctccacagtcctccctactgactggctttctgcctttgttttctcagccatgatgaggagcagccctgggccaggtgccacggtcagtatgagaggctccaggatcaggctagagaaccacgcgaaccaggtctggggagctatctgtgggaaaggtcagggcctgtttttctcctaagctgctggctgttcaagggacctacctccttgtcccttcccagtcacaggtccaaggggcaaatagcgaattcccatggaggagaatcactgcactccaagtggacgtggctggtaggtaagtgtaactttttctgctgctgttcagtggtactgagagacaggaaagccccactgctcccgccccaccctttgtgatgggttatcaatgacagctaataaagccacctcactgcttcctcatgccagcccttgacccacaaacactggaggagacctgcctcaggtcccatcccccaccacaactgggctttagctgaaagttgtgggtttctgaacttcaggaataagtctttggggacattcgtt

SEQ ID NO: 292397 - DNA, 686 bp, Homo sapiens
tctagttacatttaatatatagtattttcctttgcccttattttctgttaactgatggttaaatcagaggcgtgatcagatttgggttacatttgtttggcaaaaacatttcataggtagcgttgtgtgctttcatcaggaagcatctaatgtctactttgtctttagttgcttattaagattgatcacttagtataggtgttgccagcttgatccatctattacaacttttccaccagctttttacttgatggttttaaacagacattgatattcatgactcacttttatttttaaaattgtgattgggtactagtacagctaaagaagcaaaggaatattttgctgatatggaaaggcatcgcatcttgtttagatatgctggtcctgaagatgatgctgccattaccttggtaattaagttaattttttaaaagcttttgttagccatccccctaccttctattcctttcctcccagtcctggttccctatgataagtctcttttgaatgctcaagctagttaattttaatttttcccccagatgatgctgtgcttgtataaacttctttaattgaaagaccttagtttaaatgtgtttttgattaaaatattgtaaaataacctaatttttccagaaattaagaattagttattggccacttatacattttaattttgtaat

SEQ ID NO: 292398 - DNA, 799 bp, Homo sapiens
gcatgtgctgagtctaggtctgagaaggaatatgtatttgacattttatagttaatactggtggttctcatatggtgccacttaatgtgggatatgcaattggttgttactagtctttgataagtaaaacggagtaaacatttagacctttataataatgtgttactaaaacagcatgtgattacattttttagtaatttgtgttctatggtatttttaaaagtattggcccatgacaaattagaaatgaaaaaaaatatttaaatcccatgtaatttaagaagtactcttccaagatatttccttttcaggctcaaggaccaaatagcaaatacaaatgttttatgtatgaagggattcatcattaaaatttgtctttgggactttcccactagtttaaatgtatttgtcaaaaagtctttggtcatgtcaaccccagaattgaaatgctactgccaaattgtttataatcactcatagtaagagatcaggactgcaatgctccactgattgggcatgccaaagaaataaactacaatgttgtggcatttatctttttatattgcacttaaccacggaagaaaaaaccttttgtatcattttaaggtaaaggccgaggggcaaagaaaaggaaagcatctggctctgaaaatgaaggcgattataaccctggcaggaaaacatccaaaacaacaagcaagaaggtaaccgggaacatcattgcatattagtgcatggctttttaaaaaaagatctgtaagtgacttagtttgcttatgactatagtcctggaacagct

SEQ ID NO: 292399 - DNA, 549 bp, Homo sapiens
ccccgccttggcctcccagagtgctggcattacaggtgtgagccaccacgcccagccaggcaactcagtttctaatcagctataagaaattccatttatataggactctcttcagtttggtttgttggtaagtatattgacctgtgaaatggaaatttgcttactagggaaaaccgtcttcagatacagtccctaagcccaagagagccccaaaacagaagaaagtagtagaggctgtaaactctgactcggattcagaatttggcattccaaagaagactacaacaccaaaaggtgaggattatcttcttataaccctttaaacatatgctgtgtggaaaagattgaattttttctacctcattgaatttagagaggctaggtatctattttgttttaaattgctttactcctcagtaagcagtgtgtctaggaatcagtgctgaatatagtccaaaggaggcatagcaatttagttcagtcactttgttttacaaattaaaaaattgaggctcaaagaggttaaataagaatccctaagaatggtcc

SEQ ID NO: 292400 - DNA, 587 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgccactgcctgggatcttcgcgtcggggcccgagccatggaggatatcatcgtgatctcggacgacaacggctctgagagctccgaggggcgcccgcccgggccggtacgaggaggccgcgcacgggccctgttaggcgaacctccggagcgctgacccgacggacacgtgaccaagggtcaaaattagaaccaatccctcatcgaagactaacgaatga

SEQ ID NO: 292401 - DNA, 5878 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtgttctctgtctctttactgaagataaaggtgtagtaaaagctcccacacacctttaaaataaatatattttattctttgcagga

SEQ ID NO: 292402 - DNA, 5792 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292403 - DNA, 6136 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactaaaaaaaaaaaaaacaaaaaaaaaaaaaaaaaaaaacaaaaagaaacaaaacaagccaaccacaccaaccaaaaaggagagcaacaaaaaagaaacagtccacaagaagagagagccaacaatgaaacacgagaacagggatagcaagaaagagcccgccgcgccgcgcaagaacgaacaaggcgcagagaccacgtccgaaccggcaaccaaacggcacgcagcgaaaatgcgccagggagcgccgtgccgaccacggcagccggcacaaaagcgagcaggcagaccacacagcgggccgcagacgcgacccacgcgcgagaagccgcgcacacccggaaggt

SEQ ID NO: 292404 - DNA, 5900 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactaaaaaacaacacagacgcacaacacagaagccacacaatacaacaacacaaacacacagacacaaaaaaaccatagaagaccaagaaacacaacagatcagaaaacac

SEQ ID NO: 292405 - DNA, 5532 bp, Homo sapiens
tctgtctcaaaaacaaaacaaacaaacaaactgatatcttacagaattgggaaatgtttgtatttttggattgctggagactgctctagtgattctggtgactatacccacgttttgggctcagtcaaaactacaggttcatgttgtataataagagccagacggtcagtaaatagacctgtgttttctttagatttaaaaaatcagtctgaaagataattttgtcattaaaaaagaaaacccatgtcgtgtgtccatactcattgtctaccccttggtaggttatttaaatttgattttttggttaattttagactctttttgatcagaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaactgtgttctctgtctctttactgaagataaaggtgtagtaaaagctcccacacacctttaaaataaatatattttattctttgcagga

SEQ ID NO: 292406 - DNA, 5794 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctctgacccatcctatcccctttcctctccattccaaacccctctctctttaaaaacccctgcattccccccacaaattgaagggtggaaatttttggaaagaatctcacccactccttcccttgttagcatggctaataaaatctccttta

SEQ ID NO: 292407 - DNA, 3556 bp, Homo sapiens
tctagttacatttaatatatagtattttcctttgcccttattttctgttaactgatggttaaatcagaggcgtgatcagatttgggttacatttgtttggcaaaaacatttcataggtagcgttgtgtgctttcatcaggaagcatctaatgtctactttgtctttagttgcttattaagattgatcacttagtataggtgttgccagcttgatccatctattacaacttttccaccagctttttacttgatggttttaaacagacattgatattcatgactcacttttatttttaaaattgtctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292408 - DNA, 3209 bp, Homo sapiens
tggagtagatggagatggcataaaaacatcttagtatatacctgcagatggctttctaggaaaaaacaaacaaacaaaacaaacgtgttagtatgtactcactttgttacagaatctcaagtaacaattttactggtgttcttgaaaagcaaattgtatctttgctttattcccctgaattgttacaactatatcttgaagtaacattttaaaagagctcttttaaaaataggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292409 - DNA, 5681 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292410 - DNA, 1944 bp, Homo sapiens
gcacttgtagaattttaaactaattattcaataaaattcaacattaatttgatactatacaagactttaatatacagtttgttattttttacaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292411 - DNA, 5402 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagcgtcttcagatacagtccctaagcccaagagagccccaaaacagaagaaagtagtagaggctgtaaactctgactcggattcagaattgggcatcccaaag

SEQ ID NO: 292412 - DNA, 5399 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaggtaaccgggaacatcattgcatattagtgcatggctttttaaaaaaagatctgtaagtgacttagtttgcttatgactatagtcctggaacagct

SEQ ID NO: 292413 - DNA, 1410 bp, Homo sapiens
  misc_feature (34)..(34): n is a, c, g, or t
  misc_feature (68)..(68): n is a, c, g, or t
tgccagtaaacgttactgatacctgccagttgtnccgctatctctgtcaaaatggacgctgcattccnactcctgggagttaccggtgtgagtgcaacaaagggttccagctggacctccgtggggagtgtattgatgttgtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292414 - DNA, 1476 bp, Homo sapiens
ggggtgatctgtgacgtacgtgcagcaggttaaaattgtggcaatgtgtgtcatgtaacaagttcacgtggagacaccacgtgtagaagtgtgctaggagcaatgaggtacttgacctccattcaagttcgctactagaagtaaaggctcccagatcctgaagagggatcaagaaggagctcctggatagctacgagtatgatgaaatcatcatccatacagtcagtctggtaagacctacgtgtcatcagaatatgtgacacgcaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292415 - DNA, 5596 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgatgatgatgatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaagaagattctgcttctgttttttcaccatcatttggtctgaaacagacagataaagttccaagtaaaacggtagctgctaaaaagggtatgtacttatatttgattgagttaagcattggatagagatagttaatgtaaaaggaaatgtaatttaatttgaaactatttgcatttttttatcataaaacaattaagaagtataagtgcttataaggagaacctctcgttttctagccatctgagggcgttaataaaatttctgtaagacttaattttaaagctgttgtaattataaaataatcccgtgcattactatctaaagatagctttctacaaaagctcccttgtggttaggttgtaatggagattaaaattttgtcttgctagtagcttgcttctgttatctatgttgatcatgactcaactccttatgtggagggattggtcagctcagttgaggtcctctttttctatgtgagtcatgcagcttctctctttttcacagccttagattggccacaaaacactttgagttgattaatgaatctcttactagtaccaagatatatgtaccgtggtctttttgaaagaggtcagtatt

SEQ ID NO: 292416 - DNA, 4940 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggcagcagaagaggatgaaacacaaaaccagcatgatgatagttcctccgattcaggaactccttcaggcccagattttaattatattttaaatatgtctctgtggtctcttactaaagaaaaagttgaagaactgattaaacagagagatgcaaaagggcgagaggtcaatgatcttaaaagaaaatctccttcagatctttggaaagaggatttagcggcatttgttgaagaactggataaagtggaatctcaagaacgagaagatgttctggctggaatgtctggaaaagcaattaaaggtaaagttggcaaacctaaggtgaagaaactccagttggaagagacaatgccctcaccttatggcagaagaataattcctgaaattacagctatgaaggcagatgccagcaaaaagttgctgaagaagaagaagggtgatcttgatactgcagcagtaaaagtggaatttgatgaagaattcagtggagcaccagtagaaggtgcaggagaagaggcattgactccatcagttcctataaataaaggtcccaaacctaagagggagaagaaggagcctggtaccagagtgagaaaaacacctacatcatctggtaaacctagtgcaaagaaagtgaagaaacggaatccttggtcagatgatgaatccaagtcagaaagtgatttggaagaaacagaacctgtggttattccaagagattctttgcttaggagagcagcagccgaaagacctaaatacacatttgatttctcagaagaagaggatgatgatgctgatgggacaatcttgctcccatcagaaatgattccctctgatgaagaggaggaggacgacgaagaagaggaggaggaagaagaacctaggctcaccattaaccaaagggaagatgaagatggcatggctaatgaagatgagttagacaacacctacactgggtcaggggatgaggacgccctatctgatgggacgaagatgcg

SEQ ID NO: 292417 - DNA, 847 bp, Homo sapiens
  misc_feature (48)..(48): n is a, c, g, or t
tgtgagatgtggctttcacctccccccatgattgtgaggccttcccanccacgtattctgcttctgttttttcaccatcatttggtctgaaacagacagataaagttccaagtaaaacggtagctgctaaaaagggaaaaccgtcttcagatacagtccctaagcccaagagagccccaaaacagaagaaagtagtagaggctgtaaactctgactcggattcagaatttggcattccaaagaagactacaacaccaaaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292418 - DNA, 3962 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactatagagaataggtcaaagaaagatttgattcaaatgttagtccagagaggttatgaatctgacccagtgaaagcctggaaagaagcacaagaaaaggtaatcatttgcagaaaaag

SEQ ID NO: 292419 - DNA, 3870 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggtaagatacaacctttaaaa

SEQ ID NO: 292420 - DNA, 4070 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactacaaaaactttaaaggcacgattcaagaacttggtcaaaaccagtatgcagtcagtggtgaaatatttgtagtggacagaaacacagtagaaattacagagcttccagttagaacttggacacaggtatataaagaacaggttttagaacctatgctaaatggaacagataaaacaccagcattaatttctgattataaagaatatcatactgacacaactgtgaaatttgtggtgaaaatgactgaagagaaactagcacaagcagaagctgctggactgcataaagtttttaaacttcaaactactcttacttgtaattccatggtactttttgatcatatgggatgtctgaagaaatatgaaactgtgcaagacattctgaaagaattctttgatttacgattaagttattacggtttacgtaaggagtggcttgtgggaatgttgggagcagaatctacaaagcttaacaatcaagcccgtttcattttagagaagatacaagggaaaattactataggcagcagaagaggattattttacttgtaggtggagaggaaattatacaattgacttgatatcaaatttaagaatttgaacagaaactagtttttaattaattaattaatttatttatttatttttgagatggagtctcgctctgtgcccagactgaagtgcagttgcgcgatcccagctcactgcactccagcctgggtgattaagagagactccatctc

SEQ ID NO: 292421 - DNA, 1192 bp, Homo sapiens
gcatgtgctgagtctaggtctgagaaggaatatgtatttgacattttatagttaatactggtggttctcatatggtgccacttaatgtgggatatgcaattggttgttactagtctttgataagtaaaacggagtaaacatttagacctttataataatgtgttactaaaacagcatgtgattacattttttagtaatttgtgttctatggtatttttaaaagtattggcccatgacaaattagaaatgaaaaaaaatatttaaatcccatgtaatttaagaagtactcttccaagatatttccttttcaggctcaaggaccaaatagcaaatacaaatgttttatgtatgaagggattcatcattaaaatttgtctttgggactttcccactagtttaaatgtatttgtcaaaaagtctttggtcatgtcaaccccagaattgaaatgctactgccaaattgtttataatcactcatagtaagagatcaggactgcaatgctccactgattgggcatgccaaagaaataaactacaatgttgtggcatttatctttttatattgcacttaaccacggaagaaaaaaccttttgtatcattttaaggtaaaggccgaggggcaaagaaaaggaaagcatctggctctgaaaatgaaggcgattataaccctggcaggaaaacatccaaaacaacaagcaagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292422 - DNA, 3493 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataattcccatggttttaataaatggtgctgagggcattggtactggatgggcttgtaaactacccaactatgatgctagggaaattgtgaacaatgtcagacgaatgctagatggcctggatcctcatcccatgcttccaaactaacaaaaacactcaacacggcaccgatacacgaactcgggtccaaacccagtatgcacgccagcggtgacaatatcgtcagcggaccagaacaacagtagaacatcacaagagctacccggagcaacaggacacaggttactaccgacacggtaacaacccagag

SEQ ID NO: 292423 - DNA, 3252 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttgtgggaagtaacaacattaacttgcttcagcctattggtcagtttggaactcggcttcatggtggcaaagatgctgcaagccctcgttatattttcacaatgttaagcactttagcaaggctactttttcctgctgtggatgacaacctccttaagttcctttatgatgataatcaacgtgtagagcctgagtggtatattcctataagcccatccagtaccaatgccctcagcaccatttataaaccatgggattataggatataccactca

SEQ ID NO: 292424 - DNA, 702 bp, Homo sapiens
ccaccaaggtggtgaattactgtatgtaatctttttcctccaaaaaataagataactggtcttacacttaggttagcattatgattctaattttaaaagcaccattatttgtaatacttcctaaacataagcgaagtttaaggagtgatagttcttaatactagtctttacttcctttcataacttttaaatctattgaaaaaaaatctagaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292425 - DNA, 577 bp, Homo sapiens
  misc_feature (1)..(1): n is a, c, g, or t
nctggtggaactcgggggcacgcttgggggctacggctctgaagtgaaggcgatataccctggcttttacatccagacaatccgctaaaccgaagaagacatcttttgatcaggattcagatgtggacatcttcccctcagacttccctactgagccaccttctctgccacgaaccggtcgggctaggaaagaagtaaaatattttgcagagtctgatgaagaagaagatgatgttgattttgcaatgtttaattaagtgcccaaagagcacaaacatttttcaacaaatatcttgtgttgtccttttgtcttctctgtctcagacttttgtacatctggcttattttaatgtgatgatgtaattgacggttttttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292426 - DNA, 2880 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggtaattaagttaattttttaaaagcttttgttagccatccccctaccttctattcctttcctcccagtcctggttccctatgataagtctcttttgaatgctcaagctagttaattttaatttttcccccagatgatgctgtgcttgtataaacttctttaattgaaagaccttagtttaaatgtgtttttgattaaaatattgtaaaataacctaatttttccagaaattaagaattagttattggccacttatacattttaattttgtaat

SEQ ID NO: 292427 - DNA, 1147 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcaggtaattattgctaaaattgattgaaattaggagatgtgcatctatatttactttttaatatgttgataaaattattgtaattacttgctttggaaatttgtaatttcatctgtcatagtcaaagtagggtgaaagatctagaagtagaaatgtatttacttctttttggggattaaaaaccgtcagaagaggctgagcgcagtggctcacacctgtaatcccagcactttgggaggccgaggcgggtggatcacaaggtcaggagatcgaaaccatcctggctaacatggtgaaactctgtctctaataaaaatac

SEQ ID NO: 292428 - DNA, 382 bp, Homo sapiens
tgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtaaagtctgaatggaattttggttgaaaaatactgttttcttaatataaaatgtataacttactaaggaaattgtgcagttttggtgtgagaaaatcattgtcagaattaatatttataaactatcatgtataaatattgtcttggtaatagtttaacagtgacatttaaaaaccttaagactgatagtacattgactttatgttagaactgctggaagtttaacttggctgaca

SEQ ID NO: 292429 - DNA, 3180 bp, Homo sapiens
gtgcggtgttatgccggacaagagggaggtgaccgtggcggcggcggcggcggctctgtttattgtccctctcggtgtgtgtgtgtgaggaaatcggggctgcagcgaggctaaggcggcctttgaagcagcggcggcgaccgggacgactactctggcgactcgagtggctggccttcgcggagtgtgagaaggacaaggcacctctgcgtcctcgccacgtccgagcgcctcgggctccccggccgccctcgcggctcgcacgcccgggcttcagcccggcctgcagcggcgcccgcgggcgggcgagaaggcaacgccgccgctcggccgccgccggtcgctccctgctttctcctcagccgccgcgctaggcccgggcgacgcggacgccgcgcctcgagtttgagggcagccggcggcgcggcctcctcagcgggctcggctggacgtccgctccggatcttcgcgatggggcgcgggggtcggcgcggctaggagtgcggcgagtggagcggtgggtgcggagcggcggggcccagcggcccgcagggaggcgggagcggcggctgcggcctcagggcctgtgagctggaggcactcgccatggccaagtcgggtggctgcggcgcgggagccggcgtgggcggcggcaacggggcactgacctgggtgaacaatgctgcaaaaaaagaagagtcagaaactgccaacaaaaatgattcttcaaagaagttgtctgttgagagagtgtatcagaagaagacacaacttgaacacattcttcttcgtcctgatacatatattgggtcagtggagccattgacgcagttcatgtgggtgtatgatgaagatgtaggaatgaattgcagggaggttacctttgtgccaggtttatacaagatctttgatgaaattttggttaatgctgctgacaataaacagagggataagaacatgacttgtattaaagtttctattgatcctgaatctaacattataagcatttggaataatgggaaaggcattccagtagtagaacacaaggtagagaaagtttatgttcctgctttaatttttggacagcttttaacatccagtaactatgatgatgatgagaaaaaagttacaggtggtcgtaatggttatggtgcaaaactttgtaatattttcagtacaaagtttacagtagaaacagcttgcaaagaatacaaacacagttttaagcagacatggatgaataatatgatgaagacttctgaagccaaaattaaacattttgatggtgaagattacacatgcataacattccaaccagatctgtccaaatttaagatggaaaaacttgacaaggatattgtggccctcatgactagaagggcatatgatttggctggttcgtgtagaggggtcaaggtcatgtttaatggaaagaaattgcctgtaaatggatttcgcagttatgtagatctttatgtgaaagacaaattggatgaaactggggtggccctgaaagttattcatgagcttgcaaatgaaagatgggatgtttgtctcacattgagtgaaaaaggattccagcaaatcagctttgtaaatagtattgcaactacaaaaggtggacggcacgtggattatgtggtagatcaagttgttggtaaactgattgaagtagttaagaaaaagaacaaagctggtgtatcagtgaaaccatttcaagtaaaaaaccatatatgggtttttattaattgccttattgaaaatccaacttttgattctcagactaaggaaaacatgactctgcagcccaaaagttttgggtctaaatgccagctgtcagaaaaattttttaaagcagcctctaattgtggcattgtagaaagtatcctgaactgggtgaaatttaaggctcagactcagctgaataagaagtgttcatcagtaaaatacagtaaaatcaaaggtattcccaaactggatgatgctaatgatgctggtggtaaacattccctggagtgtacactgatattaacagagggagactctgccaaatcactggctgtgtctggattaggtgtgattggacgagacagatacggagtttttccactcaggggcaaaattcttaatgtacgggaagcttctcataaacagatcatggaaaatgctgaaataaataatattattaaaatagttggtctacaatataagaaaagttacgatgatgcagaatctctgaaaaccttacgctatggaaagattatgattatgaccgatcaggatcaagatggttctcacataaaaggcctgcttattaatttcatccatcacaattggccatcacttttgaagcatggttttcttgaagagttcattactcctattgtaaaggcaagcaaaaataagcaggaactttccttctacagtattcctgaatttgacgaatggaaaaaacatatagaaaaccagaaagcctggaaaataaagtactataaaggattgggtactagtacagctaaagaagcaaaggaatattttgctgatatggaaaggcatcgcatcttgtttagatatgctggtcctgaagatgatgctgccattaccttggcatttagtaagaagaagattgatgacagaaaagaatggttaacaaattttatggaagaccggagacagcgtaggctacatggcttaccagagcaatttttatatggtactgcaacaaagcatttgacttataatgatttcatcaacaaggaattgattctcttctcaaactcagacaatgaaagatctataccatctcttgttgatggctttaaacctggccagcggaaagttttatttacctgtttcaagaggaatgataaacgtgaagtaaaagttgcccagttggctggctctgttgctgagatgtcggcttatcatcatggagaacaagcattgatgatgactattgtgaatttggctcagaactttattattgtggtaggccttttaacattttgttcttacacatacagttttatgctcttttttactcattgaaatgtcacgtactgtctgattggcttgtagaattgttatagactgccgtgcattagcacagattttaattgtcatggttacaaactacagacctgctttttgaaatgaaatttaaacattaaaaatggaact

SEQ ID NO: 292430 - DNA, 673 bp, Homo sapiens
cggccttttccaggttaaatggtaacccagtcaggggttttttccccccagctttgaaacttaagctgcagggctttttttatttaccccccgtaccgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292431 - DNA, 1047 bp, Homo sapiens
agtttgagaccagcctgggcaacatggcaaaaccccatctctacaaaaaataaaagattagccaggcttggtggcatatgcctgtaatcccagctactcaagtggttgagatgggaggatcactggaacccagtaggcagaggttacagtgagcccagctagcaccactgcactccagcctgggtgacagagtgagatcctgtctcaaaataaaagtaaataattaaacatgcataagcgtctgaaaacttgttattagtgactgtcaaaggaagcttttttaaaggtctgcctactcctacgaatttacattctgctgaaatcagtgaaagatgttgaaaagaattttctcaatagatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagtgggtaaaagtctccactgtaataaatgccatttgatcagatgagtgggaagtacaaagatgatctttttaaaagaagaaggggccaacagggccttaatcatgagctctttaggaaaaggcaggatttcatgtcatgatacaggacttgcttattaataaggcattcaggttgctaaaatatgacgagacatggttccaaagaaaagtagtgtttttccgctacttaaaacttcccatcagtttttaagggtttatttgacttagcagttcaccaggggcttaaaaactactctaggctga

SEQ ID NO: 292432 - DNA, 469 bp, Homo sapiens
gtctagaggaccccgttcaatctctacaccaagatacaaggccctctgaggcaagacttacctctctgtactgcctatgagctctacaaaggaatctctgttcataactaagcattcatgatggaaaggcaagagtatgaaaacagatatcacatatctgaaataacaatacagctagagggaagacaagaaaaaaccagttaagagggacatggaaataaatattcacattaaacatgaggtgcaagtccatggttcaataatacattgggggtttttgcttagcacctatttggaagtaatcgggtaatgtaactttgaaatggaaatctaaatcatgtttttatatatgttggtgataacatagactgttatggagagtaatttcttttttttttttttttgggcggggacggagtctcactcttgtcgcccaggctggagtgcagtggtgcgatctcggctcact

SEQ ID NO: 292433 - DNA, 384 bp, Homo sapiens
tcatacaactgtagaccctgtttttaaagcaatattcttgtttctttgttactcgaataatacatgctcattacaggtgatttggttctttctgattgcactttcactagaaccctgtttaccatggcaagttaggggtgcctcactgtccttacctttccctgcctcttacatagaaaaagtagtattcacttaggggttttttggtattgtttttatctgttctgaacaggtgaaactgaacagtattttaaagaatctgatcgaggagaacgtttggaagagccagaaagtactaaagaatctaaatcatcatggaaaagagtttcttttgggaggtagcacttagtgtctctgaatttgatgaaaacaagttacgctttt

SEQ ID NO: 292434 - DNA, 2878 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaatgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292435 - DNA, 3694 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292436 - DNA, 3588 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292437 - DNA, 3544 bp, Homo sapiens
tgacccaaaaacgggatttattgggggcccagtcatcacctggaagtcaaaaggcgttgaagtttcggggggattttcatgatgagcaggaacagggctcattatggcaggactgtggatcggtccttccaggacaccgtcgccttcccggccgcgtcggagtccggcggcgacctgcctctgaaacatggcaggctcggatgctgtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292438 - DNA, 3277 bp, Homo sapiens
tgaaacaattgaaggatatttaatgcaaagttagcatcccacccccttcactcccacaccctagagtcaccagtatttgctgttctcctatacatttaatcgttgacactttatatacagctatttctaccattcatatatcagtgaaaacaaaacataagcagcaagacatgctaagcagcaaaagggagagtcttttcctttttctgcacccagcagctctccaggtcctcaggggaagggccctctggtcaggctgggccctgagtgaaggagggaacttttccaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292439 - DNA, 3601 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292440 - DNA, 3102 bp, Homo sapiens
ctttcatggtgtgtgaaagttaagtgctccttgtcttctgagatgttgggcccctcttgggatggagatgaagcagaatccactggtgaaatcattagacttggagacacagcacacaccttttctctaagaagtaatggtcttgctctgtcacccagggtggagtgcggtggcgcaatctcggctcactgcaacctctgcctcagcctctcaagcggctgggattacaagtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292441 - DNA, 4616 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccaggtactaccaactgagcagtcaccacggccggagaaaacgggcaccttccctgctctgcgaggagacagaaagctgagctctgcaacatgacagaggcatcaactcaggatggcatgtgttcttgaacttttcattttgtgactcatgttgtcaccctccatagagccaaccataaatgttttcaaaacgattcattacaaactcaatattctttaaaaacgttgatgctgtgacagtgcaaacagcattgattttattgctcgacttcggcatgggcacatacatagttaatttttaaaaaccatttatacagatgttactgataaagctcatgtaacaaatgaatgaaaatacaaagaatatcaaagctaaaacactctgtaataaatacaaatacaatgaaaatgataaaactttgtttttaaagtcagtctgagagaagaatattacataaagtgaactaattacatctagaaataaaacaactcagcatttggaacaatcatcctaacatgttaaataccacaaatggcacccgttgactgtacgcttagaaaacaagcagaaggagccactctcccaaactaaggatggttggaacagcctctaactcccaacaatccaatcagtccaatgcactggaaattcaaagcccagatttagtgttgtaaagtaaagcgaattacattgtatttgaaagaagagaatcttgtgctccggactgtaaatacatgaaagaaaaaaaggcttggtaaaaaacccattcggggcaacaaactatgtgcaaaacaaaatgtacactatacactatacactatgcactatttaaaaactacaccaagatacaaggccctctgaggcaagacttacctctctgtactgcctatgagctctacaaaggaatctctgttcataactaagcattcatgatggaaaggcaagagtatgaaaacagatatcacatatctgaaataacaatacagctagagggaagacaagaaaaaaccagttaagagggacatggaaataaatattcacattaaacatgaggtgcaagtccatggttcaataatacattgggggtttttgcttagcacctatttggaagtaatcgggtaatgtaactttgaaatggaaatctaaatcatgtttttatatatgttggtgataacatagactgttatggagagtaatttcttttttttttttttttgggcggggacggagtctcactcttgtcgcccaggctggagtgcagtggtgcgatctcggctcact

SEQ ID NO: 292442 - DNA, 2666 bp, Homo sapiens
agtttgagaccagcctgggcaacatggcaaaaccccatctctacaaaaaataaaagattagccaggcttggtggcatatgcctgtaatcccagctactcaagtggttgagatgggaggatcactggaacccagtaggcagaggttacagtgagcccagctagcaccactgcactccagcctgggtgacagagtgagatcctgtctcaaaataaaagtaaataattaaacatgcataagcgtctgaaaacttgttattagtgactgtcaaaggaagcttttttaaaggtctgcctactcctacgaatttacattctgctgaaatcagtgaaagatgttgaaaagaattttctcaatagatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292443 - DNA, 2515 bp, Homo sapiens
atacgaatcgagccgttacccgatgagtaatctggccgatgagtaaatctggcgatgagtaaatcttggcgatgagtaaatcttggcgatgagtaaatctggcgatgagtaaatctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292444 - DNA, 5558 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatggtaagtctgacttttctgtccagccctgttaagaaggtgaactttgttatctttcaggaccaccttctttgttcgtgactcttgtccaaatttgaatccaaaatctaaactgaagtcctatagtgctggccctgagttctgcttggccacacttcattttcttactccattgtgcattcccgtccattctcagtctccgtgtccctcatcttaatgtgaagtcttacttcctccctgcctcctacacataacaggtacttctccagtaaaactactttagaggtttgggaacatgtgagagacaaatttagtgtgataacatgaccttgcattccacataaaatcaggactagtgtccagctgtgctgtgaggggttttccacaaggatgacatttgctatgtcatcctaatcaggctgtgaaatgattaaccttttgagatcccaagctagcaataaatttcatctgtaaaatattttagtaattatagtttactaaagacttggacatatttctagaggaaggctttgaggagagcgtaagtaacttgtctgtagctcatgaatgcgtcgccgtcagaaccagtttttctatccagaatttacactgatgaagggaggacaagtgcgcatatccaagccctttgagcagtgtgttttccggtggcctccccaaatgatcactccccctcctcagtgatgtacatgtgtaggtgtggcatgtttctgctcttggcgttcttaccctatgtacatggctgcttgacactgcttttctgaaggttgtaaagaacctctgtgatacatgaaaagataatgaacaccttcgtcattagggaaatacgactcagaaccacagttagaggacgagtgttggcaaggatgtggagaacttggggctgtaaaatggtgcagctgctttggaaaacaatctagcagttcctcagaaggttaccaaaaggtcatatagagttaccctatgacccagcaatttcactcctagctatataatcacacaaaaaacacaaatgttcatagcattacttataatagcctaaaaggggaaacaacccaaagtgtccatcagttaatgaatggataaagagtgtgcattcattcatacagtaggatgttacttggcaataaaaaggaatgaagtattcatacatactgcagtatagatgaaccttgaaaacatgcggagtgaaagaaaccaaatacgaaaggccacgaattacatgattccatttttaggaagtgtccagaatatgcaaatccatggagacagaaagtacagactggtgactgctaaggatgggacagggggaatgagcactagtcagtatacggtttctttttggggtggtaaaaatgttctgtagtggtgatggttgcacaactgagtataataaaacatactgaattatttattttaaaagggtaaggctggactcagtggctcacgcctgtaatcccagcactttgggaagctgaggtgcaaggattgcttgggaccagcctgggcaacatagtgagacgtcatctctccaaaaaattaaaaatttagccaggcgtggtggcacatgcctatagtcccagctatttgggtagccaaggtgggagaattgcttgagcctgggaggtcaaggctgcagtgagttgtgactgccccactacactccagcctgggtgacagagcaataacctgtctcagaaaaaggaggtacattttatggtatgtcaaaacatctgaataaaactagtatttaaaaaaaaaaaaccttgggaaatacaatcagtatatacctctagttggccaaaatgatattcctcaatgactatttttacgattaaataactgacagatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292445 - DNA, 4449 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccaggtactaccaactgagcagtcaccacggccggagaaaacgggcaccttccctgctctgcgaggagacagaaagctgagctctgcaacatgacagaggcatcaactcaggatggcatgtgttcttgaacttttcattttgtgactcatgttgtcaccctccatagagccaaccataaatgttttcaaaacgattcattacaaactcaatattctttaaaaacgttgatgctgtgacagtgcaaacagcattgattttattgctcgacttcggcatgggcacatacatagttaatttttaaaaaccatttatacagatgttactgataaagctcatgtaacaaatgaatgaaaatacaaagaatatcaaagctaaaacactctgtaataaatacaaatacaatgaaaatgataaaactttgtttttaaagtcagtctgagagaagaatattacataaagtgaactaattacatctagaaataaaacaactcagcatttggaacaatcatcctaacatgttaaataccacaaatggcacccgttgactgtacgcttagaaaacaagcagaaggagccactctcccaaactaaggatggttggaacagcctctaactcccaacaatccaatcagtccaatgcactggaaattcaaagcccagatttagtgttgtaaagtaaagcgaattacattgtatttgaaagaagagaatcttgtgctccggactgtaaatacatgaaagaaaaaaaggcttggtaaaaaacccattcggggcaacaaactatgtgcaaaacaaaatgtacactatacactatacactatgcactatttaaaaactacaccaagatacaaggccctctgaggcaagacttacctctctgtactgcctatgagctctacaaaggaatctctgttcataactaagcattcatgatggaaaggcaagagtatgaaaacagatatcacatatctgaaataacaatacagctagagggaagacaagaaaaaaccagttaagagggacatggaaataaatattcacattaaacatgaggtgcaagtccatggttcaataatacattggggggtgccgatgaataggggatcctctaagt

SEQ ID NO: 292446 - DNA, 4351 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccaggtactaccaactgagcagtcaccacggccggagaaaacgggcaccttccctgctctgcgaggagacagaaagctgagctctgcaacatgacagaggcatcaactcaggatggcatgtgttcttgaacttttcattttgtgactcatgttgtcaccctccatagagccaaccataaatgttttcaaaacgattcattacaaactcaatattctttaaaaacgttgatgctgtgacagtgcaaacagcattgattttattgctcgacttcggcatgggcacatacatagttaatttttaaaaaccatttatacagatgttactgataaagctcatgtaacaaatgaatgaaaatacaaagaatatcaaagctaaaacactctgtaataaatacaaatacaatgaaaatgataaaactttgtttttaaagtcagtctgagagaagaatattacataaagtgaactaattacatctagaaataaaacaactcagcatttggaacaatcatcctaacatgttaaataccacaaatggcacccgttgactgtacgcttagaaaacaagcagaaggagccactctcccaaactaaggatggttggaacagcctctaactcccaacaatccaatcagtccaatgcactggaaattcaaagcccagatttagtgttgtaaagtaaagcgaattacattgtatttgaaagaagagaatcttgtgctccggactgtaaatacatgaaagaaaaaaaggcttggtaaaaaacccattcggggcaacaaactatgtgcaaaacaaaatgtacactatacactatacactatgcactatttaaaaactacaccaagatacaaggccctctgaggcaagacttacctctctgtactgcctatgagctctacaaaggaatctctgttcataactaagcattcatgatggaaaggcaagagtatgaaaacagatatcacatatctgaaataacaatacagcgtgtagcaattgtaccgggatactcaaga

SEQ ID NO: 292447 - DNA, 4887 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatggtaagtctgacttttctgtccagccctgttaagaaggtgaactttgttatctttcaggaccaccttctttgttcgtgactcttgtccaaatttgaatccaaaatctaaactgaagtcctatagtgctggccctgagttctgcttggccacacttcattttcttactccattgtgcattcccgtccattctcagtctccgtgtccctcatcttaatgtgaagtcttacttcctccctgcctcctacacataacaggtacttctccagtaaaactactttagaggtttgggaacatgtgagagacaaatttagtgtgataacatgaccttgcattccacataaaatcaggactagtgtccagctgtgctgtgaggggttttccacaaggatgacatttgctatgtcatcctaatcaggctgtgaaatgattaaccttttgagatcccaagctagcaataaatttcatctgtaaaatattttagtaattatagtttactaaagacttggacatatttctagaggaaggctttgaggagagcgtaagtaacttgtctgtagctcatgaatgcgtcgccgtcagaaccagtttttctatccagaatttacactgatgaagggaggacaagtgcgcatatccaagccctttgagcagtgtgttttccggtggcctccccaaatgatcactccccctcctcagtgatgtacatgtgtaggtgtggcatgtttctgctcttggcgttcttaccctatgtacatggctgcttgacactgcttttctgaaggttgtaaagaacctctgtgatacatgaaaagataatgaacaccttcgtcattagggaaatacgactcagaaccacagttagaggacgagtgttggcaaggatgtggagaacttggggctgtaaaatggtgcagctgctttggaaaacaatctagcagttcctcagaaggttaccaaaaggtcatatagagttaccctatgacccagcaatttcactcctagctatataatcacacaaaaaacacaaatgttcatagcattacttataatagcctaaaaggggaaacaacccaaagtgtccatcagttaatgaatggataaagagtgtgcattcattcatacagtaggatgttacttggcaataaaaaggaatgaagtattcatacatactgcagtatagatgaaccttgaaaacatgcggagtgaaagaaaccaaatacgaaaggccacgaattacatgattccatttttaggaagtgtccagaatatgcaaatccatggagacagaaagtacagactggtgactgctaaggatgggacagggggaatgagcactagtcagtatacggtttctttttggggtggtaaaaatgttctgtagtggtgatggttgcacaactgagtataataaaacatactgaattatttattttaaaagggtaaggctggactcagtggctcacgcctgtaatcccagcactttgggaagctgaggtgcaaggattgcttgggaccagcctgggcaacatagtgagacgtcatctctccaaaaaattaaaaatttagccaggcgtggtggcacatgcctatagtcccagctatttgggtagccaaggtgggagaattgcttgagcctgggaggtcaaggctgcagtgagttgtgactgccccactacactccagcctgggtgacagagcaataacctgtctcagaaaaaggaggtacattttatggtatgtcaaaacatctgaataaaactagtattta

SEQ ID NO: 292448 - DNA, 4184 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccaggtaataattaagatagaagccaagtcatgcactgcatggcaatgtttctttcagcaagggacctcgtacattggtggttggagcaataggctgtatcatatagccccggtgtgcagtggactgtactctctaggtttgtgtaagtacactgacattttgcacaacaacaaaatcatttaatgatgcatttcttggaacatatctccatcattaagtgacacatgactaatttacatttttaggaagtagaaaaccaaatgtattatacctgtaaagggaatggagagaagactaataaggcaatccatctatgacccaagacatttttatcctatgattttaactttagttaggtctctgtaagagctgctgttgctagattattgaaaattttggaggagtttgattagctggaagatggagagggaacaatagatgagggcctggataaatgctgtgaacagcgggatgacatgccttcttttttcagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292449 - DNA, 783 bp, Homo sapiens
tggctgctgttcggagtgtccgggacggcagtgaatccaggatcatggtcgatagcagtacgcgaggtagtcgcatgaggggagtgagttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccagacattacataaggtgaagagggagctgagatctaagatggagaaggaaattcagcagctgcaggacatgataacacagaatgatgatgatgttttcttccgggaactggaagctgagcgcttcagatctcggcttcagctggcttcctttcagtacagtaaaagtccctccctatgaggccagacttgataatagtaggtgaaggttctggaggcctttaccaggacagagctagaatcgagccagtaaacagtctaagccagaaaaataattttcaaatgctttacctgtattttcattccagtactttttatgattttttaaataaaaattgttttctaaaagcttaaaaaaat

SEQ ID NO: 292450 - DNA, 3774 bp, Homo sapiens
  misc_feature (3724)..(3724): n is a, c, g, or t
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgtgcaaaaatgatgagaatgaggacccgggaagaaatgatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccagttttcattgctggcagaagccatatcacaggaacatcaagaacttaaagccagagagaaatctcaggcccaggtactaccaactgagcagtcaccacggccggagaaaacgggcaccttccctgctctgcgaggagacagaaagctgagctctgcaacatgacagaggcatcaactcaggatggcatgtgttcttgaacttttcattttgtgactcatgttgtcaccctccatagagccaaccataaatgttttcaaaacgattcattacaaactcaatattctttaaaaacgttgatgctgtgacagtgcaaacagcattgattttattgctcgacttcggcatgggcacatacatagttaatttttaaaaaccatttatacagatgttactgataaagctcatgtaacaaatgaatgaaaatacaaagaatatcaaagctaaaacactctgtaaanaagcacgatgcggccactttccctcctattttatcacataatcgcagaat

SEQ ID NO: 292451 - DNA, 3178 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctggagcagtttccgtttctttatgtttctggcccaacactaagcaaaatgtggaaacagcaaattgcacaggttgaacagcttaagaaagaagcatgtagagaaaatcgatcaaagaagaaactccaagatgaaatagaagaagccctaagaaggcatgacctccttactacccttgtcaagaaagaatatgaacataacaagagactgcaagacttcaaggactgcattcgtaggcaaaggttgacccaatcaaagataaaagaaaatcgacagcaaatcgttcgtgctcgaaaatattatgatgattatagagttcagttgtgcgtgagatgataccactgtttactccaggtatggaatccatgattagcagatgagataaggagctgtttgcgggttcagagtgttcctaggttatc

SEQ ID NO: 292452 - DNA, 2075 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacacggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggatctagatgatggacttttcttaatttccaagttgcctaaaggcagcaaatgggaagtatatccagctcaggtccaagggcctaggacaaggaagcctcccaaaggaaaaagaaatgaaaacagagctacagcctcatcctgcaattcacctttcccccagaggccaagaaagagattaacagaacaagaattacatgatgtatcagaaaaactctctcagcggctttctgaactagattggatgttaaaaagtgctctgggtgatcggattaaagaaaagactgaccataaagaagaaaatactggaaatgaggaggtagaggatggaactgaggagacactgtctcagcacagtgatggcatcgtggagtatgggccaaagaagtcaaggccaggactttccatgcgtagaaagccaccctacagatcccattcgctctctccatctccagttaacaaacacaaacagttccacttggagagaaaaaggcagcgcaagccaagagaaacagatgtccgccaattccaagcacaggcgtttactgaagcatttgaaagggaactaagaagacataaagttcaagagaatattggacctctaagaatacatgagaaggaggaggaaacagtgggtaaaagtctccactgtaataaatgccatttgatcagatgagtgggaagtacaaagatgatctttttaaaagaagaaggggccaacagggccttaatcatgagctctttaggaaaaggcaggatttcatgtcatgatacaggacttgcttattaataaggcattcaggttgctaaaatatgacgagacatggttccaaagaaaagtagtgtttttccgctacttaaaacttcccatcagtttttaagggtttatttgacttagcagttcaccaggggcttaaaaactactctaggctga

SEQ ID NO: 292453 - DNA, 1122 bp, Homo sapiens
tctctaaacttcccaaaccgcccccgtttcacgtcctgtgaaaggaagtgctcctctgatgaccaatcagcggcgagaagctcttttaacgtccgtccttctttcacgcctccttccccgcgctttggttcgtgcgtccgcgccccagtgtcgggtctgcgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtgaaactgaacagtattttaaagaatctgatcgaggagaacgtttggaagagccagaaagtactaaagaatctaaatcatcatggaaaagagtttcttttgggaggtgctccttgtcttctgagatgttgggcccctcttgggatggagatgaagcagaatccactggtgaaatcattagacttggagacacagcacacaccttttctctaagaagtaatggtgctcaatgtcctaatgaaatgctgtctaaaaaagccttagcctcaccaagttctaaatcacatgaagatatgttgtaccctcctagtgttttgtccaagagtaggacatcctttgttgaagacagtgagttgtaatggatgttagttctttactgctgatgatcattcttggggcaattgttgttgcattagcctttttacttttattgctgtatatgagatcctttttggtcttacatgatcttacttgtaaatgtttgctattaattatggtatctgaattctgcttaacatggtc

SEQ ID NO: 292454 - DNA, 915 bp, Homo sapiens
tgacccaaaaacgggatttattgggggcccagtcatcacctggaagtcaaaaggcgttgaagtttcggggggattttcatgatgagcaggaacagggctcattatggcaggactgtggatcggtccttccaggacaccgtcgccttcccggccgcgtcggagtccggcggcgacctgcctctgaaacatggcaggctcggatgctgagtgggtaaccattgccaataaccttctttttaagtgtcatatacatctgagaatacatgaacttcaagactgtgatgctaatgtttttattgctctttatcagtctattttgggagaaaaggtaccagacctcatagttattcctaggagtcaagaagatgatgcacacaatgtacaagcagtaattgattcactggccttggactacttgcaggtcagcttgtctcacataacaggagaaaatatagtgaaaggagataaagaatctattaagaatctcctggaaatatttgatggtttgttggagtatcttacagaacgcatcagtgaaacatctcatgagaaaagtctaatatatacttacctggcaatatttcctagagctgatcaggttcttcaaaatgccagttaacagtaatgggaaacaaatctttattatcactaatcatatcagctgtgcagggcagcttcaacctgggacctgagctagcattatcatttaccactgaagaaggaggggttcgaaggaagaccatgggttcagtgctgggttcttcctctcactatatgatggcagctctctaagcctgttttctcatctgaaattctttcatggttgttgtgaaagttaagtaagtagatgtgtgtaaacagttgggcacacagcctagctcagagtaaatgcataataaatgttaattgatgtta

SEQ ID NO: 292455 - DNA, 412 bp, Homo sapiens
ggatggtagtgcctggctaatgatatggcagtggggatgaagagaggaggaggcaactgagagatacttttatgtgagtctggtggtggtgaaagactgaaggatattcccaggggagatcggcagtatgtggtgagctactggggaagttgctcagataggcttccctatatgacagtaccttagctggacagcattttcttacagtctgcttctcatctttgcaggtctaatatatacttacctggcaatatttcctagagctgatcaggttcttcaaaatgccagttaacagtaatgggaaacaaatctttattatcactaatcatatcagctgtgcagggcagcttcaacctgggacctgagctagcattatcatttaccactgaagaaggaggggttcgaaggaaga

SEQ ID NO: 292456 - DNA, 460 bp, Homo sapiens
tcctaatttaattagatccctgtgtgctgaggctatatccctggtttaattatttttttatgtgctttgtcttaagtttaaaaaatatttctaatgtatgtgaacatgtttatataggtatgtatgtatgtatataaaatggtttatttcttagaattgcatcgtaatatccactttaatttgtcttactagcggaaaccctttctgtgagtgggattccaaatgctaggaagctaggggagcctatccgagcagctattcctttacatccaccctaccacccttcagagcctcgagcaccctgccccataggaaaagaatacttgcattcaagtcactgctccccagccgtaaattctactggagagcatacggaattttctggggtaagtggaaaagcttactttcagttggctagaagtacacttgtatgtatgtctgtgtgtgtgttggtaattga

SEQ ID NO: 292457 - DNA, 384 bp, Homo sapiens
acctgtctcatcctcaccgcacgcggctaagagcttggatgctcggttgaggcaccattggaattgaaactcaggatctcctgtttactagacaggtgctttaaccagctaagccatggtgctgcccgttgtgtatgtttttaataactgtaatatatgaccttttcccctttaggcgtttactgaagcatttgaaagggaactaagaagacataaagttcaagagaatattggacctctaagaatacatgagaaggaggaggaaacagtgggtaaaagtctccactgtaataaatgccatttgatcagatgagtgggaagtacaaagatgatctttttaaaagaagaaggggccaacagggccttaatcatgagctctttagg

SEQ ID NO: 292458 - DNA, 382 bp, Homo sapiens
ttgtacgaaattgtcaaaataacaaaattctggggatggagaacgggttactggttgtcagcagttaggggaggtctccagggaggagggatgcctctggggagggcggttctgtgtcttgaggggagatgctcgttatgtgaacgtgcgtgtgacacaggtgtccatctgtggagcacacacacaggtgagagcacataggagtgggggcatctgagcaggggcctggcgtttccatgtcagtctcctggctttgcctttgttttgcagctactgaacgcacagctgctgggggaccagggccaaagggactgctctgtgctgtttttgcaatttgttgtgtgtctgttaccatcagaatacaaaacttaaaaagtcacac

SEQ ID NO: 292459 - DNA, 1487 bp, Homo sapiens
gtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgagtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaa

SEQ ID NO: 292460 - DNA, 1060 bp, Homo sapiens
  misc_feature (311)..(311): n is a, c, g, or t
cacgtgatggctggagtctgctggagtcgcggcgctccctggggcgcgatcgacctcgcgccatggggccaagttgactgtgtggaccacggtgtgtcgggtgcggccatcggcgagtctcgagtgtatctagcaccggtgtgagtgatcctcgcgcggaaaggatgacatatgtggttggcacctgggaacacagcaaatttctcgtgcatagcatccttatgatcgcgaatacctctatgctcggtcgcgcattctcgtgcatgcatcacgttcttacagctttggtctcgggagctcgcgtcacactnacagtgagggttagtgcgcatgaagctaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaa

SEQ ID NO: 292461 - DNA, 1793 bp, Homo sapiens
gtgagtgcacttgtgtgtgggtgactaagtggatgcatgtgtgtgcctgtgtgagtgagggtatgtgcacctaagtgtgtacatgtgtgtatgttgtgaaagtgtctgtgcacatgaatgtttgtgtgagtgtgaactctttcttactgctggaagtcacagaattcatattgctgcccgggttggtgtggccacctttccctttgtccaagactccacatggaaggcatttgagctcgacctccgaaaagctacccagcaaagagcagtctgtgcctctgagcagaccgtgagaactcaggggacgagtggctaagagcatggcctctcccagaacccacccagggtggtgtggtgggggcaacaggggccagactcctctagagggagggtggctctggggccctggaaaacgtgagagactgccctgagctggtccagtgggccagcactttataccaactcagcatttaagggaagtatcttagattgcctccatctcaatgtgaatgcaccaggctgagggttccctagcgccttgagtcaaggccacttttcagcccatcgagccctgagttctacttggtgtttgttctctggagctgattgcacttgagctctgtggtgggcaggcgcactttagcctaagttgggtgccccagggcaccccctcctctctgctccttgccagcttcattcactcccagcctctcgctgtcctcactttgcaggggctcctcctcaacatttgcatgcacctgcaagaattgggaagaaagagcatttattaggcactgtagcaatttgcattttaaaatgcctgagcatttattaagcttcttggtattcacttgggtttgataattgatctgagctacctcattgaatgtttttggaaaggtgttttttggtatgcaagtcagctttgcctcacagttgaaaatgttcggtcatgattgcttttgaaaccaaaggggaaggtaccgatatcattgagctatttaaagttgccagtttgggctccagtaatgctttctggtgggtaaaattccacattcaggccacgagagcatctacagtttgtactctggggctgcaggcatcctgggacgctgtacgcaattcagtggtctagtcctttataccgactcagattccttaagcatgcagagtcactcgaatgaaaaaacatactcgacctctccctaaaaagatgttgcaacccagtttctctgaattccaccacaaaaagagaccctgaataagaagagcagttttcctgtgcatatagagggtgtgtcaaaggtgagctttttggggaccgggaaaaacaaagttgcctgattccgcgcaggtgcacaggccccggatgtacacccggaaaggggagtgtggctgtagaatcatccatccgtctacagctaaaacaatttgccaataaagtacatgtttttcctaagccaaaaataaatacgttaacagaaaaatgatttaggatatagcttgaatgcttaaatatgtgcacctttacaaacctctcagtgtattcttggagttcttgaaatgttgttttaatatttgttgccagtaatgttctttcttcacagccgctccgggaattctgaagttctgggcctttctcagaagactgtaatgtacctgaagtttctgaaatattgcaaacccacagagtttaggctggtgctgccaaaaagaaaagcaacatagagtttaagtatccagtagtgatttgtaaacttgtttttcatttgaagctgaatatatacgtagtc

SEQ ID NO: 292462 - DNA, 1095 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttagaaaaaaaaaaaaaaaaaaagggcgggggtaaaaatactcgaggggcaagtaggtaacagtttggaaaggggccaaggggggaaaaaagaacgggcgggaaagggggggaaacggtggatttgagagc

SEQ ID NO: 292463 - DNA, 839 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcaga

SEQ ID NO: 292464 - DNA, 378 bp, Homo sapiens
  misc_feature (11)..(11): n is a, c, g, or t
tgactctagangatcccgcagtcaatatgatgaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatcatattgaatgcgggccgagctcgatta

SEQ ID NO: 292465 - DNA, 283 bp, Homo sapiens
  misc_feature (27)..(30): n is a, c, g, or t
  misc_feature (32)..(32): n is a, c, g, or t
  misc_feature (55)..(55): n is a, c, g, or t
cgggccccgcaccgttaggtatatggnnnngnaactccagttttatagaacccgnatagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcaga

SEQ ID NO: 292466 - DNA, 641 bp, Homo sapiens
tctgtttaacgtttcactttgcctttcttcttcacttaccaattggaagctttcctgataaatggatgagagccaagcagtttatataacctgaagatgattgaatttcagctttgtgagaatgaggaaacatgcatgtgttacaggccaggccttaaaaggatgcttataaaccaaaataattctatgctggaaaaacctgttggctttggtgctttaagttctttgtaaaatgattacttatctgcaagttctcttggatacttagacataaagttcagcgaagctaagataaaaaaataactcagggatatttcattgttttatttattcagacaggcctgtcttcacttcttattatactgaagttatgtaccatttgcaaatgtaagagtacctttggattcttcagctaccttaataaatatttgttagacaccagacctattttattcaaagcttattttaatatttgctctttctttttacagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcaga

SEQ ID NO: 292467 - DNA, 534 bp, Homo sapiens
cattatgatttcactaagattactggccatgatttggctatcaaatttgcaagtttttctcattccttaagatacaactcttgtaaaataaaggcttgtattcaattacactagtgtctacactttttcttagtattgttccccctaccttataaataggcttaagttactattttcagatctgaagatcattttccttgatagagaatatgtattcttttcatcttcggtaaatattatacaataaaaatgagttcatctgttcttttcctttcttgttcaaaatacaccaccaacaaaaccattttagattgtactgtatgttccctataacattacttaacaaaataaatcataccttggaaacactgtgctttctgtaaaatgtggtggtccattcaccatgtacagtccttctgatcctcggactgtcaagagcggcgtggacggcgccatgttgtcccggaaagagaaaccgctcgggtgagagttcaccagggccgaacccggcccctacacgtctcctcatgcgtg

SEQ ID NO: 292468 - DNA, 3179 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggcttttggggatcctctaggatcgca

SEQ ID NO: 292469 - DNA, 3168 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292470 - DNA, 3164 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292471 - DNA, 3170 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaaatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292472 - DNA, 2914 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292473 - DNA, 3169 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttcagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292474 - DNA, 2694 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttcatcatattgaatgcgggccgagctcgatta

SEQ ID NO: 292475 - DNA, 2507 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatcatattgaatgcgggccgagctcgatta

SEQ ID NO: 292476 - DNA, 3101 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccacggctccagaggaggcaggcgagtgagcgagtccgaggggtggccggggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292477 - DNA, 2660 bp, Homo sapiens
accattacggctagtacgaggccggggttaatcggccgaggccgaccagcagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292478 - DNA, 3266 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggtcagtcacttcacatgcccatcctgatactttgaataatctggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292479 - DNA, 3025 bp, Homo sapiens
tctgtttaacgtttcactttgcctttcttcttcacttaccaattggaagctttcctgataaatggatgagagccaagcagtttatataacctgaagatgattgaatttcagctttgtgagaatgaggaaacatgcatgtgttacaggccaggccttaaaaggatgcttataaaccaaaataattctatgctggaaaaacctgttggctttggtgctttaagttctttgtaaaatgattacttatctgcaagttctcttggatacttagacataaagttcagcgaagctaagataaaaaaataactcagggatatttcattgttttatttattcagacaggcctgtcttcacttcttattatactgaagttatgtaccatttgcaaatgtaagagtacctttggattcttcagctaccttaataaatatttgttagacaccagacctattttattcaaagcttattttaatatttgctctttctttttacagcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292480 - DNA, 2766 bp, Homo sapiens
gttgcaatgtcattaaggagagaaggaagagaagtaagccgagggcgttttgattgtgtagtaagggtggaaggtgattttatcggaatgggaggtgattcctagggggttgtttgatcccgtttcgtgcaagaataggaggtggagtgctgctagggctgcaataatgaagggcaagatgaagtgaaaggtaaagaattgtgtgagggtgggaccgtctactgagtagcctcctcagattcattgcaacacggtctctggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292481 - DNA, 1729 bp, Homo sapiens
gggcggacctcacaacgtattttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292482 - DNA, 1748 bp, Homo sapiens
agcttcctagaacagttcgtttgtgtcgcgtgcctagtagtaagtgatcatggtctttcctgtgggctaagaaatcctggtcatgataatgcttggatactgatcaatatggaagcgctcgtgcggaacacgatgcgtgctgaccaagtgccagattggagatctgaggatcgttactgaatctaatcaactaggagtccaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292483 - DNA, 2319 bp, Homo sapiens
  misc_feature (1360)..(1360): n is a, c, g, or t
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattctatcttcaccctacttttccctatctcttcttcccttaccccccattctcttctctcttcattttcatattcctccctcccctccctcccttctcattctccttctcattcactcctcctacttcatcactctcctcctcctccttcctctcttcttctttcctctctctcttcctccttccggctcttcctcctgcgttcccctctcttctttctcttcttctcttctttttgtgtttgtgtgttttcgtcgttctgtctttttttgtgttccttttttgtttattgttctgtatgttagttgatgttttttcttctctgttttctgtgttgctttcgtttatcttgtctttgttctttgtgttgtctctagttcttctttgtgtactgtgtttnagagaaaattttatagagatgggaaaaagagagaagaaaaaagaacccttggagctgctgtgcttatatactttcttggtgttgtaccaccaccatgtgtgttttgcggggcaactcacggtcccccgcatcgctgcgatgctccgagttccgcgcggggcccttcttcgctatggggttctctagtgtcacatcgccttcccaagaaagcatctggtctgtactaacagcttgctgtcttcagtacaggccttcataatgtcagtcacgctgctcttgcaatgatccctaatgcaaaagagttttcagtgctgataggtggtgctatgatcgatggtgtgggattgaatccatatgcacattgagcttcatttcattgtcaagaatttgaacaagttgttgcatggatggaaggtgaccagattccagcttagaccacacaggtacatcatttaaagttatctcaaatgcacctgttgacatacactggttctcaatcatgttgctcaagaagaaaaccatcatacatgcataaaccttattttcttggccccactgccagatgctaggagcttgcatgccaaagaaagcaaaaggatccttgccaacaattattaagcctattaatactagtttgaagactgacaggaaagatgctatgtgtctatatattggttgagggaggtaattctctccttcaatgcggatgtctgggtaccgctggctaataacccgcatgtactcctcaaacacccgcctataacctcaggaaacacaaatctggaacttgagcagcggccccgtggcgtactgcatctttaatctcttgctgggcacgccgcccagattggccgaggcctcgctccggaccatcgcagacgccgccactaggagaagcagcagaagcctcatcttaaatgagccagccacttcggccgccctcagacagactgcccgct

SEQ ID NO: 292484 - DNA, 1094 bp, Homo sapiens
  misc_feature (11)..(11): n is a, c, g, or t
tgactctagangatcccgcagtcaatatgatgaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292485 - DNA, 998 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgatttgatgtggacaaaaaaaaaccggggcttttggggg

SEQ ID NO: 292486 - DNA, 1056 bp, Homo sapiens
  misc_feature (985)..(985): n is a, c, g, or t
  misc_feature (987)..(987): n is a, c, g, or t
  misc_feature (1043)..(1043): n is a, c, g, or t
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgatgaaaactcgtgcccgatttcggnangggatttacagggcatgctgatgggtcagttaagttctggggtggttctgcaatanctctacaagtttt

SEQ ID NO: 292487 - DNA, 948 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaccatcgtcgggtaccgagct

SEQ ID NO: 292488 - DNA, 1093 bp, Homo sapiens
tggaacctgcgactttcatacaggaacgatcatgatatggagcatagggaaacccgagtgacatgtatctatcactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292489 - DNA, 1028 bp, Homo sapiens
gccgcccctactactactaaattcgcggccctcgactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292490 - DNA, 898 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccagcgtcacggtcgcgcccaagcatca

SEQ ID NO: 292491 - DNA, 857 bp, Homo sapiens
tagacatgatagaatcgattcggtaccagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292492 - DNA, 1112 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaatgttttgtaactccattatcagtctttgcaaagaaaattataaatatgtactatagatgttagaacttgatttaacatataccagaatctaatgtcttaatgtcaaaattgagtata

SEQ ID NO: 292493 - DNA, 840 bp, Homo sapiens
cagactccccggctcctcgggtagttctcaaaggcaaagacaaaaataagaaactagtctgaagaaagagagtccctcgcttcttcagaactcacctgtcaagagcggcgtggacggcgccatgttgtcccggaaagagaaaccgctcgggtgagagttcaccagggccgaacccggcccctacacgtctcctcatgcgtggagacagcgaattggtgtttccggagccatcagcctcggggccaattcacttccggttacggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaa

SEQ ID NO: 292494 - DNA, 868 bp, Homo sapiens
gggggggatgcgtgcatttatcagaccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgatttgatgtggacaaaaaaaaaccggggcttttggggg

SEQ ID NO: 292495 - DNA, 3223 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttagctctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgcaaaaaaacacacacaaccaacacaaacaaag

SEQ ID NO: 292496 - DNA, 3008 bp, Homo sapiens
ggagtgacgcggaaaaggcgcccgaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatattgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacatta

SEQ ID NO: 292497 - DNA, 2954 bp, Homo sapiens
cgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaaaaaaaaatctggtg

SEQ ID NO: 292498 - DNA, 2901 bp, Homo sapiens
cgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagatgaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaaaaaaaaatctggtg

SEQ ID NO: 292499 - DNA, 2160 bp, Homo sapiens
  misc_feature (17)..(18): n is a, c, g, or t
gagatagccggtccacnntctcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcgtggggagatggaggcagagcccagggtaggggacagagctgctggggcctttccttgcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaaaaaaaaatctggtg

SEQ ID NO: 292500 - DNA, 2895 bp, Homo sapiens
cgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctacctgttgtcccaaggcatacaaaggaggcctcaacgctcatgcttctctaatcaagccctaccaagacagacagaaagacagacagaaaaaaggaaggggtagaggagaaggttgaagctgtggagctagactctgcttcacttcctgaagcttcaacttcatgtcgaagattcactgggacccaattcctgcattgttaatatttgtgaggaaaagtgaaacaagtgatctggttttagcccagatgatgaaagtggatatggcacattttcacacacgtgagataattacagcttgccccacaacactgggtgttggagaaagggagagatagtcataagtggaagaaaaagccaagcatagtgagtgggaaagagagtgagagcctgtgcaggctgctgacgagccccaggcagcccacaagtttctcctgggaatctgtcccaggaagagcttccccactcccatcccccaaattggaaaaaccgtacattcaagcctgtttggccctgaaattcttaagaatctggttaagaattaactcactaatgtcaaaagtcaaaacctcctaggggttgtcctgggagtcaggttcacgggtacagaagatgaatctcagatgtcactcaacctgagccgtcattctctgtggcagggctgccctgggtttctcttactcaatccctggagtgtaagcatttggattgtgtcacagattacctttttaccttttctttctttttttttctttttttcaatatcagtgcccacaccttactgagtattgagttttagagctttcgcttgatgtgcttgaccaagagacttcttttgtatccttttcttgtcctatgatgtaaataaaagcctcgatttatgtaaaaaaaaatctggtg

SEQ ID NO: 292501 - DNA, 2067 bp, Homo sapiens
cgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttggcagtgtggcatgactgtttaaagtagataaaaccttgtcattttaccccatccctgcatgactgtgaagctggcgaggaaggaggaagaagggcaagttcagatgcaggctgggtggctgggacaggttggctaagggactactctggagggctcttctgcctggcattgcccacttcggcccagccacgtgtttgcagcgaccagagtccctgcaaaggtgtggctggctgtggtcagggtgctactagcaccatcagcgcactcccgccattggctcagctcctctctgccagtccaactaagagtgctttgtcctgggtgggacataggggctgagagagatggggggagacataacacccaggaatgaaaatacagatttagagaaggaaccagtaagtaggagacagatgtgaaggaaatggaaatgaggcaagaggacattggaagagagaagtttgctgtccaggagccaggtctggagcatcagtgtgagggagttcaggtaggctgggcctgtgcctctaggtagggacaagggaggctgggtagccagggctggtgcttaaaacccctgaggccatgagctcattggctgcctttgtagcatcctgtcttcttctgtgctgcctggtttgatctcatctcacctggattcaaagggtaaggtgggcatgggtcttgggcctgacacccaccaaggatgacctgtggactgccatcggatgctgaacagggagatgaaaggaggtcctcttaccatacccctctgccaaccccccagtaggccactgttctgactttgtttccagaatatccagaaatccaaaggggctgttgctgaacagtctgcaggaccagtgacagcacctaccttttgtatccttttcttgtcctatgatgtaaataaaagcctcgatttatgtaaaaaaaaatctggtg

SEQ ID NO: 292502 - DNA, 1156 bp, Homo sapiens
  misc_feature (1136)..(1136): n is a, c, g, or t
cgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaagaatgtcgggaaggtcatcatcaaaggatgccgctacgtggtcatcggcctgcaaggcttcgctgcagcctactccgccccgtttgcggtagccaccagcgtggtatccttcgtgcgctaatgggagctgctgtggcaggtgcccccagagtgaacgggagcccctgctgtgggaactttgtgaatcctggagcatctcagacttgaacacacagcatatttggaagagaaaacatgcctttctttgttgaatcacattagtatgatgagtgagtcatccctgcccatctgctgagcttctcacatctctcagtcacacgtggacccagtggtcaatcctgcagagaattcggcggaggttaggtttgggagtggagctagcgtgctaaagccagagccttcacgtgaaggtggcaggcactggggcggaagccaacactcaacagatgcaagcagtgtgggtgtgcagcagaacagtgatcttgggggaggaagaggatgttactagagtcagatgatttgctgtattctcctgaaaggtcgtaggctgacaggcgctcacattccttggctgcctcggttctgagggcagctaaggagctgtttattcctcaagtcatgctccccgatctccttcctctaccactctgtcaccaggagtttaattacaggcttgaggagaagaaaggaagaaaagatatcttgatgctttgaaaactgtgttgcttccagatgtggnccggctcgatcttcgtgggt

SEQ ID NO: 292503 - DNA, 306 bp, Homo sapiens
ccccgcccccgggctcagctgctcaggcgcgcgcgggaggagggggtgggggtagtggcggagtaggtggtgggaacgggaaggctggggaagggaggactcaggaacagagactgagggtcggcgaagcgggaggggaggaagcgaggaggaacgccgccgccgggttctcagccgccctgttgccgctgccgctgctgctgctgctgctgctgccgccgccggccgggcagcgcctcacggggcgggctgcgctccgctgtcgccgcgacgcttcctgctgctgctgctgttgccggcggccgc

SEQ ID NO: 292504 - DNA, 380 bp, Homo sapiens
acgcgatcgctggggagctggggtcgctgcgctcccggcctgcagttacctggtccagcgggatgcccaggagctcgctgagcgggtgcaggtgccccagctttgtccctgaatatgtgcttaatctgccagccagggatccagaagcaccatctccctgtctgcattctgatcacccacctcacttccagagcatgagagaaccacgatgaagaaagtcatgtgctaagaaaggcagagaagaaaagctgaagaaatctgggtgattgacagaaaccatgattaatgacatcacggagctactagaccagcccgggcctgcctgtctccatgcttcttggaacgtgagaaaaataaactgtatttgattatgttccttt

SEQ ID NO: 292505 - DNA, 1172 bp, Homo sapiens
tttttttaaagagagaaaagggaatttcttgtgtttgaaactaagcaaacctcagatgagtctattcccttcatgtcagatatggggaatggtatcatatcacagttcataattactaaggatgaaaataggggcccaacttaatagtcatacgtaaacactacccaaaaattaacacttaagccaatgtgaatgttacgttgacagatcctcagacccagaaatcttcccatttgtaaaataggattagactagcccaaattttctccttttggaagaaatgctccatgctcaaacaacatagagcatatttgctatgtgcagtagggcagctttgtttatatgttacatattttatcaccgatgtattttttcctctggggctcatgctttttccctctctctagttcagatggtttgtcaacagtgaccctggttggaatcatagttggggtcttactagccatcggcttcattggtggaatcatcgttgtggttatgcgaaaaatgtcgggaaggtactcggaggtaaatagcttacacccatgtgataggcaaatgaaagccatcgtgtctagaactcaaatctttgaactaatagaaatctctgatataagctgggtgtggtggctcgtgcctgtagtctcagctgctgggcaactgcagaccagcctgggcaacatagtaagaccctgtctcaaaaaaataatctctggtacaatggtcatgttccaaagttccttacttgggcctcttgagtgcagtggctcacacctggaatcccagtgctttgagaggctgaggaggcaggaggttcacttgtgcccaggaatttgaggctgcagtgagctatgattgtgccactgcactccagcctgggtgacagagcaagactgtgctctcttaaaaataagaaagagcctcttcatcttcaaaaggactacatctgaagtttccccagaaggacaaatgtctacttagaccttataaatttccaaaataagagagtcagagccagaggtggcttgtaagttgacttctgttgagatctgaccacatttgatctcttgttttaattttccaactaactgaacttggaagaaaacccaaaccaagttttaatctgatgcctaatcagcccgtctccaaccatcagagaaaaggcttctaga

SEQ ID NO: 292506 - DNA, 2817 bp, Homo sapiens
agaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtggaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccatttttggcaatgatgtctggatgttattttaaacagtgtgtctgtgtgttcccaaatccagctggccccaccagctcagattccatttttttgtgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactttcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaacaa

SEQ ID NO: 292507 - DNA, 2413 bp, Homo sapiens
agaccaccttgcggccgaccccgctcccccgcctcctcgggagagataaatgctgactccgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtggaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccatttttggcaatgatgtctggatgttattttaaacagtgtgtctgtgtgttcccaaatccagctggccccaccagctcagattccatttttttgtgtgtgtgtgtgtgaaacgtagtctgcaactctgcctcccggcaattatacatgtgtcagaattgcttgaatctgggagatggaggttgcagtgagctgagatcgtgcccctgcactccagcctaggcgacagagtgggactccatctcaaataaa

SEQ ID NO: 292508 - DNA, 2655 bp, Homo sapiens
ttcctttttggcgagacaatgtgcaaatgacaccgttttgtgctcaccagggcaaagcaagggagcgccctcacttcagcatctcagccctgctaaagaaaaagctgctgggtaacatcctttgtttttgcccagggaagctttagctgtgattcccttcagccggctcctgaatgtcaaagccagcacaggccagccagaagatgacactgagactacaggtttggaaggcggcgttgccatgccaggtgccgaagatgatgtggtgactccaggaaccagcgaagaccgctataagtctggcttgacaactctggtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtggaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccatttttggcaatgatgtctggatgttattttaaacagtgtgtctgtgtgttcccaaatccagctggccccaccagctcagattccatttttttgtgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactttcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaacaa

SEQ ID NO: 292509 - DNA, 2790 bp, Homo sapiens
ttcctttttggcgagacaatgtgcaaatgacaccgttttgtgctcaccagggcaaagcaagggagcgccctcacttcagcatctcagccctgctaaagaaaaagctgctgggtaacatcctttgtttttgcccagggaagctttagctgtgattcccttcagccggctcctgaatgtcaaaggtactcctaaaagatggcgttaaaaccgaaaaaccatcgttggtgctggaaactccactactaaagaaagaagtgccagcacaggccagccagaagatgacactgagactacaggtttggaaggcggcgttgccatgccaggtgccgaagatgatgtggtgactccaggaaccagcgaagaccgctataagtctggcttgacaactctgcccctggcagccactgttctactttctatcttatgaatttgactcctctaggcacctcatgtggcaacaagtgtcaacagtgtaacaggcattcgcatcgaggatctgccaacttcagaaagcacagtccacgcgcaagaacaaagtccaagcgccacagcctcaaacgtggccaccagtcactccacggagaaagtggatggagacacacagacaacagttgagaaagatggtttgtcaacagtgaccctggttggaatcatagttggggtcttactagccatcggcttcattggtggaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccatttttggcaatgatgtctggatgttattttaaacagtgtgtctgtgtgttcccaaatccagctggccccaccagctcagattccatttttttgtgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactttcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaacaa

SEQ ID NO: 292510 - DNA, 2525 bp, Homo sapiens
ttcctttttggcgagacaatgtgcaaatgacaccgttttgtgctcaccagggcaaagcaagggagcgccctcacttcagcatctcagccctgctaaagaaaaagctgctgggtaacatcctttgtttttgcccagggaagctttagctgtgattcccttcagccggctcctgaatgtcaaagccagcacaggccagccagaagatgacactgagactacaggtttggaaggcggcgttgccatgccaggtgccgaagatgatgtggtgactccaggaaccagcgaagaccgctataagtctggcttgacaactctgagaaagtggatggagacacacagacaacagttgagaaagatggtttgtcaacagtgaccctggttggaatcatagttggggtcttactagccatcggcttcattggtggaatcatcgttgtggttatgcgaaaaatgtcgggaaggtactcgccctaaagagctgaagggttacgccctgctgccaacgtgcttaaaaaaagaccgtttctgactctgtgccctgtccctgagctcgtgggagaagatgacccgtggaacacttgcctggcccactcagaatccacggtgacctctccgcttgccaaaataaccgaaggaaagaccgttcaccagacttggctcctctaaacatttgctgttcaaacatgtttttgaatatacattctataaaagattatttgaaagacaaaattcatagaaaatggagcaaaactgtataaactgatttgtaactaacactggaccattggatcgatattatatgctgtaaccatgtgtctccgtctgaccattcttgttattgttaaaatgcagaggaatctggaaatatttatatccacggagtccttggatccagtgctacgtcagtaaatagcaccagcattttgcaattgctgatctgctgaaatgtacacattctggtctagtttggtctatcttttaaagcctgatctggtgtgaataatcaactaggaaatctaaacttggataacacgtggtgaacaactgcctttagctggtccagattaatcatttcaaagacatccattttagatcacaagcaggaagtcgatagtctcaaaggcactttgtttctcccaagtaggccaccaggcagcctctagagttgctttacccaaatccttctccagccatgacttggtgactctaagcttgctcccacctgccccctccacttccctcagatgatgaggagccagggctaagggggcagccttctctcttcccagtgatgcacatccttcacattggctgctttgttctggaatatggatatctcagcctggatgccgaggaagctgctggatgcttaatggtgctagaggctcaagtgtgtttgaaaccaagagccagttgtcccccatgcagaaagaaatcctgtgtgagcctctggtatgagaaataaaatctgccagttttataacattcactttctgcctctgaggaaagatacagggaacaaaaatcaatttgtacagtcttaatattaaaagcagcttgactaaatacctgatttaaaaatagaagacatccccagtcctcatgacataccgcaaatatctgtggggtcctgttgaaaagaacaaaataaaggagcccaaggggtcattctgtctcagcaccatccagcctggcacttctcttcccatatatccattggattttttttttttttcctaaacaaagtttttacactgagcagatgctctgtcatgatggcggttgtgcaattctggtatcctctaaatttgtaagcattcataaaacaggaaaaagtaaactatcattcggaagcacagcccattcctcccatttttggcaatgatgtctggatgttattttaaacagtgtgtctgtgtgttcccaaatccagctggccccaccagctcagattccatttttttgtgtgtgtgtgtgtgaaacgtagtctgcaactctgcctcccggcaattatacatgtgtcaggatgtcaaaaagcaattctcctgcctcagcctcctgagtagctgggactacaggttcctaccaccacacccggccaatttttgtatttttagtagagatggggtttcaccgtatcggcgaggatgatctctatctcttgacctcgtgatctgcccgcctcggcctcccaaagtgctgggattacaggcgtgtgccactgcgctcggcctcagattccatatttgaacaccagctgattgagagaaggggaatgagaagagctggatgagtttaaataactttcattgttcagattcctgaacaggagttgggataatggccatcttttctttcctatcctttcttcccccctcactgtgaaaaataacagtccaccccaagtcatacactggacccagtgcctgcggggacaggactgtgggtttcttggtcacacctgtgttggtgctcaatgcagtgtagacatgttttcaaataaaacaaatgattgtgtacaacaa

SEQ ID NO: 292511 - DNA, 758 bp, Homo sapiens
aactatacgctaggtacgaggctgggtggcgcgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccagggccttgaggttcggctcccccggctaacccttcccgtttgacc

SEQ ID NO: 292512 - DNA, 478 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtaagcggcgtgggcgcgttgtcttctctctggttcccgggcgctttagccgaggccggcgataggtttgggagcttacgggtctcctggccgtgctttgctaatgtgctctgttgctgctcgtggcatttttgtatggaaaggagaagcaccctgtaggcgtgggcgggccgatcccgaacttagtcctgcggagtgtgcctgtgggtccgtgaggttcacagcccgaatgaacgaattagtgtcttaagtagagaagaagggtgcgggaggagaacccttgctggctgtgtagagctctaacttg

SEQ ID NO: 292513 - DNA, 2309 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292514 - DNA, 2116 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcagtccagatcgagtgactgggatcctctagaacagctatacat

SEQ ID NO: 292515 - DNA, 2288 bp, Homo sapiens
  misc_feature (21)..(21): n is a, c, g, or t
caggctgtaccggcccgaggngtaaggatcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292516 - DNA, 2303 bp, Homo sapiens
gtataaataggctaggtacgaagctggtggtgaatcggcagaggcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292517 - DNA, 2284 bp, Homo sapiens
ggacgcgtgggtcgacccacgcggtcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292518 - DNA, 2488 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactaaaaaaaaaaaaaaaaaaaaaaaaaaaaataaaaaataagacaccaatatccataatctactatataaatcaacacattactataccataaaagcatctgagatcgtcgcccgctcgacaccactctatatctacttacatggcgcctccacatatcactctctcccactcacttctacctcttttctcttttcctcacgccaggacgcaatcaaacacatagaagggatacaactcgtgggatgctcaatgacagaatcggacagccgacagtgcggagagcaacgcgcgacaccgccgtaacatacgatgccgatgtcggtcgcggacggcgcgtgcgcgcgtcagcaggagtgcggctcagtacctaattactagactatgtctagctagagtctcatgtgaagcgcgtctggcttctgcgtgctctggccgaagctatcccactactcctttcatctcatggtcagtgagttgtgactatagaatagtatctgaatatatctgacaagggatcggagtggtaccgaaaagactatgtcactactatgcagta

SEQ ID NO: 292519 - DNA, 1984 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactcaaaaaaccaaacccaacaaacccaacacacaaccatacacaccaaccaggg

SEQ ID NO: 292520 - DNA, 2523 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactaaaaaaaaaaaaataaaaaaaaaaaaaaaaaaaccaaaaaaaaaaaaaaaaaaaaaaaaaaaaataaaaaataagacaccaatatccataatctactatataaatcaacacattactataccataaaagcatctgagatcgtcgcccgctcgacaccactctatatctacttacatggcgcctccacatatcactctctcccactcacttctacctcttttctcttttcctcacgccaggacgcaatcaaacacatagaagggatacaactcgtgggatgctcaatgacagaatcggacagccgacagtgcggagagcaacgcgcgacaccgccgtaacatacgatgccgatgtcggtcgcggacggcgcgtgcgcgcgtcagcaggagtgcggctcagtacctaattactagactatgtctagctagagtctcatgtgaagcgcgtctggcttctgcgtgctctggccgaagctatcccactactcctttcatctcatggtcagtgagttgtgactatagaatagtatctgaatatatctgacaagggatcggagtggtaccgaaaagactatgtcactactatgcagta

SEQ ID NO: 292521 - DNA, 2098 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctcttacaacacttttaaaaaactgaacagaaaatagggcaaagggcgaggtggcagtgccatgaggcacatggaatgtcctggtctgtggaatcgtggagggtgacaggagcagcatgatcaggcattgtatgacgaggatgacacggtgccaccatggcctgtcccgttggtgtggataaactgccctggtttggccaagagttcataggtgtgagccccgaa

SEQ ID NO: 292522 - DNA, 2313 bp, Homo sapiens
aacacatagaccaccagcaaagcacaataggcagtggagccgcgtgtaaatcggacgaggcgcgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292523 - DNA, 2282 bp, Homo sapiens
aactatacgctaggtacgaggctgggtggcgcgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292524 - DNA, 2290 bp, Homo sapiens
aatcgaaagatgtacgagggcagttacgcggtttgtaatttcagtcaccagggcctcggcgttcaattgtacaattagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292525 - DNA, 2186 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292526 - DNA, 2121 bp, Homo sapiens
acccacgcgtcgcggacgcgtgggcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292527 - DNA, 2243 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattgagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292528 - DNA, 2229 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292529 - DNA, 2254 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292530 - DNA, 1874 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292531 - DNA, 1881 bp, Homo sapiens
gaaggaccttcttcgtgctcagggcctgggagatattattgatacatccatggggtccctcacttcatccccatcttcctgctcactcagtagtcaggtgggcttgacgtctgtgaccagtattcaagagaggatcatgtctacacctggaggagaggaagctattgaacgtttaaaggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292532 - DNA, 1821 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcatggtcaatggaactctgataaaagggtaattccacgcactggctcatactgtatttttatgtgaactagattttatagctataattcg

SEQ ID NO: 292533 - DNA, 1441 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattctaggacagatccagcgtgccttgatcgaaacgagaattcagaacttctacggcagactcctaaactacagctggtgaaaccggcacggactcccggacgagagacacagaccgggcgccaggcgcgaatcccatgccggtaacacacggcacccgactaactaaggagcacaaacagcaaggatcaggcagccactaaggcacacgaaagacaggggacaccacaaacgtggacaagg

SEQ ID NO: 292534 - DNA, 1479 bp, Homo sapiens
aggaagttggctgcttttagccgatctgagccataacataggtgaggagggaggggccaatagctaggagcaatttattcatcacggactcaagtatatgtgagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292535 - DNA, 1362 bp, Homo sapiens
tggcgaattcggcacgagggagagagagagagagagaactagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292536 - DNA, 979 bp, Homo sapiens
  misc_feature (891)..(892): n is a, c, g, or t
  misc_feature (896)..(896): n is a, c, g, or t
  misc_feature (899)..(899): n is a, c, g, or t
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcaaaggcccggaatggcgcattcgcctggatnnggtncgncccctgggaagcggttggccgggttcccctgaggggggattcggaagcgggcccatcctgtggtgaaacctggcgggccg

SEQ ID NO: 292537 - DNA, 1109 bp, Homo sapiens
ggcgtaccggcggaatttgggatatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292538 - DNA, 1132 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtgcctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292539 - DNA, 1329 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292540 - DNA, 897 bp, Homo sapiens
ctagagtagtttgttcctttccattgctgagtcgtattccactgctggttatgccacatttttttcttaattcaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292541 - DNA, 1263 bp, Homo sapiens
cgcagtttctggagggagccgctgcgggtctttccctcactcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattgagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292542 - DNA, 724 bp, Homo sapiens
aggaagcggaaggccgaccaagaagtgttcccagctgggtctcgatttaccttctttgttaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcggccacatggagccattatccccattggcagaaagatttttctttaaaaaaaaagactagaataacacaagaaaccacatttaggattatgcttcactcagaggaggcaggcagggaggacacaccaggggctttaatacactgggcatgttttctttctccaattgggcaatgggtacatggacgttcactgtaacgtgctttttctttcgtcttttttttttttttttttttttttgctcctggcaagctgtgcgtgacattctttatggctttttgtatgtcaaatacttcatactaaactttctagagaattaaactttaatgatgggctcagcttggtc

SEQ ID NO: 292543 - DNA, 737 bp, Homo sapiens
cttgctttgaattgctatatgattcttgtatcaaaaatgctgtactcattttatacttgttattttttgtgtggagaggtagccttgccagggatgttggcatgaaagctgatgtggacttctctgatgtgtcgcctgtttctctgaaggcctcttggtgcttgttgtcctgacaggtgggagatgagggagcaggccacttcgtgaagatggtgcacaacgggatagagtatggggacatgcagctgatctgtgaggcataccacctgatgaaagacgtgctgggcatggcgcaggacgagatggcccagggtgaggccccggcactgcctctgtgtccgttctgcagggagtgctcactttgccacagacaccgaatcttttcttcattcctatccccttggccattcgggtggcctgcatggactcagcctaatttgagggaaactgttagtaataggcctatacactatgctagtcagtcactaagcagaaagtccccacagagtctgggtggttatcatcaccaccatttagcgtagcttacctggtgtcaggcactgtgtcactccacatacctgtcccatttactcccacagttgtcccacatggcagatgcagcagaagctttctttcctgatcaagttgggattggctttttgatagttaatctgaaaagtcagtccaagtagggaagctgaagcatttcccccaacattttattatgacaatattca

SEQ ID NO: 292544 - DNA, 1671 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292545 - DNA, 2613 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacaaaaaaaaaaaaaactcagactagcagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggtggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaatac

SEQ ID NO: 292546 - DNA, 1724 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292547 - DNA, 2393 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292548 - DNA, 2223 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292549 - DNA, 2598 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattggtatggccagcctctgcaaggacagcagaggggtagaggagagatgggaaagtgaacccagctagtcagggagaagggcaagactcatgaacacattggtgggcaggaaatagccatgggctgaggtgcccatgtccagggtccaatgcatgatggagctgggactgggggtagggggaaagcagagctctccagctctgccccttgggcaattccttcccctttgtgggcctccgtttctcactccataaaaagagaaagattagccctacccagaggcacctgcttgccccaagggatgctgggaggcctggatggtaattgaggacctcttggaagaagtggcactgaggatatggatggggccccctgcagatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292550 - DNA, 1938 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtgtgagaccctagctcggggtgagcggtgggtggcaggggttgtcccaggaggaggaagggacaggcttgggggcctgactgtgttccaattatccagcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292551 - DNA, 1689 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtccctgaagacttcatctcccgagagctgtttgacacagtccaagtgtacatcatcaccaagccagagctgcagaacaagcttatcactgtgtgagaccctagctcgggcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292552 - DNA, 2835 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattggtatggccagcctctgcaaggacagcagaggggtagaggagagatgggaaagtgaacccagctagtcagggagaagggcaagactcatgaacacattggtgggcaggaaatagccatgggctgaggtgcccatgtccagggtccaatgcatgatggagctgggactgggggtagggggaaagcagagctctccagctctgccccttgggcaattccttcccctttgtgggcctccgtttctcactccataaaaagagaaagattagccctacccagaggcacctgcttgccccaagggatgctgggaggcctggatggtaattgaggacctcttggaagaagtggcactgaggatatggatggggccccctgcagatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtgagtgggcctacagtcatacctgggacaaggtcaccagccagggaagacctcaggggccctgggtgtgagggttgggaaggcatggtcctcagaagctgagcacagctctctctctcaggtactacggcgttgtgacactggtgtccatcctccaggtaggtgagttgggtttggttaagtggagagtggatcatgtggctggaccagaccagggctgtgtcagcttcccaagcccctcactcaggcccctatgccttctgctaccctctagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292553 - DNA, 3335 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacaaaaaaaaaaaaaactcagactagcagccgcggtgtgactggtgcacaggacacttcccctctagagtcccctccgtggtcagctgttgtgacatttgaattctccaggtgctgctagggacagcataggcccgggcactgctagatgcttggtttaaaccaggccaagagtaaccctcccatccccattacaaaccaccttttcaagttttttaggttttagttttttgtttttagcataaatggtggagtagcagcagcatctcaccaggagctttgtcgcattacattttgtattttgcttttttgagacggggtctcactctgttacccaggctggaatacagtggcacaatcacagctcactgtaggctctatctcctgggctcaggtgatcctcccaaactcagcctcccaggtagctgtggctccaggcgaactactgtatatagagacagggtttccctatgttgcccaggctggtctggtcttatagtcctgggctcaagcctcccagagtgctgggattacaggcatgggtcaccgcaccaagcccgcatttatattttgagttaccaaaatgatcatcatctgtgaagcatcatggtagcttccaagcatttgcggcccactggccagtgcatccaaaacacattcaggaaacccgagagttgtaagttgcacatgtgtggcctacagtgacttccatgtagtaacagggctgagcaaggcaggctctccaccagacttaaagcattcaaccactctgcccccaggccgacactgacatgtgttcactgtcgctgccacagctggccacctgtgttcagtctccatgaaggattcaccttctgctctcactgacatctccttggctacacaaatgtgcaggtgtctcttgtcaaagctaatttttcttttctaaataaacatcctttaatac

SEQ ID NO: 292554 - DNA, 2615 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292555 - DNA, 3339 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacaaaaaaaaaaaaaaaaaaaaaaaaaaaaaaaaaaaaaaaaaaaaaaaggggggggggcacgaaataaaaatcgccacgagagaggagcggaaaagaggacagcgcccagcacgcatgtagggaaaaggaggggcgccaactaggggggcggcaatacaccagaggaggggaagggcggcaaaacaagggtgacgcggggaacacgacgcgcgggggcaaccggatggcgaagacacgccaccacacaggggggagcggacacacgggggggaccaacatcaccgcaagctaattgcaccagacggagttaacacaatagactaagggggggctagggggggaggcacaccaccagccgagagtgaaagggccgcgtgcacgagaaagcataggcgctgacccgacgcgagcgtcgtgcctgcacaccaaactattcccaaccgcgccggggcgtgatataaaaacaggcgacgctacaaaagaacaagacgagcgccgtgcacgagtgattagaacgagaacggacaacgaggaaccgcagcaagagagcgacagacaagcacgacgcagacgaaccgaccgctgacaggacgcaagactagtgaaatcaacgactaattgtagaatgaagagtgatatatataaataatcactacatgaaagcacgctaacaaatagaaaacatatagtacacactaaatagcagtctagacagaacataataaaaaagaaacaataaaaagaataataaaaacacaataaacaacacagatataccatggaacagatataaaatagagtcatatattagttcatatgaacataagaatacaaagatatactcaataacaacaaaatcaataatacagtgaagaatattaagattctaatcactataaaccttaaaaaatacagtgtaatacttactcatagacaaacatagtcaa

SEQ ID NO: 292556 - DNA, 2520 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaaggtagtggtgggttctgggggaagccatcttggggagggcagggccacatgatgagctgatccctggcacccacagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292557 - DNA, 2659 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacaaaaaaaaaaaaaaaaaacctcgtgccgaattcggcacgaggttttttttttttttttttttgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattc

SEQ ID NO: 292558 - DNA, 2181 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292559 - DNA, 2155 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtactacggcgttgtgacactggtgtccatcctccaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292560 - DNA, 3424 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccagctatactgcagcctgagccctggcactaccgtgcgagacctcattggccgccacccccagcagctgcagcatgttgatgaacggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggtggaggcaggcgggcagtcagggtgggttcagggcagggtggccaggccaaggccactgacctctcctccaccaccccacccaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacaaaaaaaaaaaaaaaaaaaaaaaaaaaaaaaaaaaaaaaaaaaaaaaggggggggggcacgaaataaaaatcgccacgagagaggagcggaaaagaggacagcgcccagcacgcatgtagggaaaaggaggggcgccaactaggggggcggcaatacaccagaggaggggaagggcggcaaaacaagggtgacgcggggaacacgacgcgcgggggcaaccggatggcgaagacacgccaccacacaggggggagcggacacacgggggggaccaacatcaccgcaagctaattgcaccagacggagttaacacaatagactaagggggggctagggggggaggcacaccaccagccgagagtgaaagggccgcgtgcacgagaaagcataggcgctgacccgacgcgagcgtcgtgcctgcacaccaaactattcccaaccgcgccggggcgtgatataaaaacaggcgacgctacaaaagaacaagacgagcgccgtgcacgagtgattagaacgagaacggacaacgaggaaccgcagcaagagagcgacagacaagcacgacgcagacgaaccgaccgctgacaggacgcaagactagtgaaatcaacgactaattgtagaatgaagagtgatatatataaataatcactacatgaaagcacgctaacaaatagaaaacatatagtacacactaaatagcagtctagacagaacataataaaaaagaaacaataaaaagaataataaaaacacaataaacaacacagatataccatggaacagatataaaatagagtcatatattagttcatatgaacataagaatacaaagatatactcaataacaacaaaatcaataatacagtgaagaatattaagattctaatcactataaaccttaaaaaatacagtgtaatacttactcatagacaaacatagtcaa

SEQ ID NO: 292561 - DNA, 2605 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaaggtagtggtgggttctgggggaagccatcttggggagggcagggccacatgatgagctgatccctggcacccacagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggtggaggcaggcgggcagtcagggtgggttcagggcagggtggccaggccaaggccactgacctctcctccaccaccccacccaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292562 - DNA, 2022 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtactacggcgttgtgacactggtgtccatcctccagtactccaatgtatactgcccaacgcccaaggtccaggacctggtagatgacaagtccctgcaagaggcatgtctatcctacgtgaccaagcaagggcacaagagggccagtctccgggatgtgttccactatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292563 - DNA, 2225 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtgagtgggcctacagtcatacctgggacaaggtcaccagccagggaagacctcaggggccctgggtgtgagggttgggaaggcatggtcctcagaagctgagcacagctctctctctcaggtactacggcgttgtgacactggtgtccatcctccagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaaca

SEQ ID NO: 292564 - DNA, 3171 bp, Homo sapiens
  misc_feature (4)..(4): n is a, c, g, or t
  misc_feature (7)..(9): n is a, c, g, or t
ggcncgnnnagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagagtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagcctagagagcagcttcgtgtccatggaggagagcaagcagaagttggtgcccatcatgaccatcttgctggaggagctaaatgcctcaggccggtgcactctgcccattgatgagtccaacaccatccacttgaaggtgattgagcagcggccagaccctccggtggcccaggagtatgatgtacctgtctttaccaaagacaaggaggatttcttcaactcacagtgggacctcactacacaacaaatcctgccctacattgatgggttccgccacatccagaagatttcagcagaggcagatgtggagctcaacctggtgcgcattgctatccagaacctgctgtgagtgggcctacagtcatacctgggacaaggtcaccagccagggaagacctcaggggccctgggtgtgagggttgggaaggcatggtcctcagaagctgagcacagctctctctctcaggtactacggcgttgtgacactggtgtccatcctccagagcagagccaccctgcccggctttatacaggctgccacagctatgacgagatctgctgcaagacaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacaaaaaaaaaaaaaaaaaaaaaaaaaaaaaaaaaaaaaaaaaaaaaaaggggggggggcacgaaataaaaatcgccacgagagaggagcggaaaagaggacagcgcccagcacgcatgtagggaaaaggaggggcgccaactaggggggcggcaatacaccagaggaggggaagggcggcaaaacaagggtgacgcggggaacacgacgcgcgggggcaaccggatggcgaagacacgccaccacacaggggggagcggacacacgggggggaccaacatcaccgcaagctaattgcaccagacggagttaacacaatagactaagggggggctagggggggaggcacaccaccagccgagagtgaaagggccgcgtgcacgagaaagcataggcgctgacccgacgcgagcgtcgtgcctgcacaccaaactattcccaaccgcgccggggcgtgatataaaaacaggcgacgctacaaaagaacaagacgagcgccgtgcacgagtgattagaacgagaacggacaacgaggaaccgcagcaagagagcgacagacaagcacgacgcagacgaaccgaccgctgacaggacgcaagactagtgaaatcaacgactaattgtagaatgaagagtgatatatataaataatcactacatgaaagcacgctaacaaatagaaaacatatagtacacactaaatagcagtctagacagaacataataaaaaagaaacaataaaaagaataataaaaacacaataaacaacacagatataccatggaacagatataaaatagagtcatatattagttcatatgaacataagaatacaaagatatactcaataacaacaaaatcaataatacagtgaagaatattaagattctaatcactataaaccttaaaaaatacagtgtaatacttactcatagacaaacatagtcaa

SEQ ID NO: 292565 - DNA, 2351 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292566 - DNA, 651 bp, Homo sapiens
gaaacgaaaaggaacaaataaggctagtagaggccggggtgaatcggcgaggctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292567 - DNA, 1033 bp, Homo sapiens
attaggctaggtacgaggcctgcgtttaattcggccgaggcagccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctgcttacgacacaccagctggtctgggcaccggaggccacataagccggggttacttactgggcctgcggtttcccggcgtctctcatttcccttggcggcgtggtggggtcccctaggggcgccctttcccggctgggtcctccacgaagggggcccggaggtggggtagccctcccctggaagcgggctgtgggaggctctccgggggtgtgggggcgcgccccctgggggggggagtccccggcaccccg

SEQ ID NO: 292568 - DNA, 1181 bp, Homo sapiens
  misc_feature (735)..(736): n is a, c, g, or t
  misc_feature (762)..(762): n is a, c, g, or t
gtaaacactgaccctttccccctttgctgctacctaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgatnnccatggaacatcatactgctgacccnttaaacctatatgccaatgggcattcatgacgggcaaccatttccagtatgtacacaccaaagccgatcatcattgcaatgatcatacaactgccggtggtaatccatatcagtcaaccatcattactggcttcaagaccaaaggtggcattcacctcgtgacgaggccactctgtgtcttgtggacttggtgcccctcgataacctggcataggtcacacagcactcgtgccctacgtcccaagagaccggcacgtgggacacccacaagggacaaaacgcagaccggagcagcccacagagccacccccggccccgggcgccacaagacacaccgcgcgccctggcgagccgcggagcgaacgatgacgccccgaggaataatacaaaggggcccccagcaaggacagccacggcaa

SEQ ID NO: 292569 - DNA, 536 bp, Homo sapiens
ctgtgggtgagggctggggcacccggctgccgcatccagcagtgcccgggcaccgagacagctgagtaccagtcattgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggctcactacaactgcgctgcagtgagctacgatagtgccacggcactccaa

SEQ ID NO: 292570 - DNA, 550 bp, Homo sapiens
tgggtgtgcgtgcccagatgagtagcagacccctagaactcgagagcaagagtgggacctgctggtggtggcgtgcacgctgcgctgcagcccccatgtcctctcagcccgtcagctgcagcctccccagacctccttcctggccggagcctggtgcttcagagcatctcagtgaccctggctgggggtaatctcgttcttgcttcctgttgagttgcttcccctcagacttccaaacggctatttgggccccaaatcactggcctggtgtgtgctgccaagcggggcagatttgggcctgaactgcttccccatctctttgtccctagtgctgtcttcgttgtcacctacctgatccttgcctgctgccagggacccaggtgagtcccagagacttaacacagtgagaggggtgacagggattgggatgggggccgagtattttggaaagaaggattcctttatagcagctgaatggaaacttacaagaaatgaggaggaggatgacgatgacagctactgttcaggtgtatacaaaggaccatgtgtg

SEQ ID NO: 292571 - DNA, 537 bp, Homo sapiens
atggcagggagcatgggagcggggctgaggaagaagtgcacattgcctctgagccaggcatctcactggggtcgcctctgggccaggctgcagctagggagggttcttgagtgggaggaaagtactgggggctggcagcttcctggggcaggccaggggtgccggatggtgacccatgcccggccgtctgtgtccaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccaggtgagtcccagagacttaacacagtgagaggggtgacagggattgggatgggggccgagtattttggaaagaaggattcctttatagcagctgaatggaaacttacaagaaatgaggaggaggatgacgatgacagctactgttcaggtgtatacaaaggaccatgtgtg

SEQ ID NO: 292572 - DNA, 333 bp, Homo sapiens
gtaaacactgaccctttccccctttgctgctacctaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtgagtgtggctgagtttagcaactcccctggctagcgttaatgctggggtttcctctcacggggaccaggccgccgggtttgcagctttagagcctgtcttggcttctgccagctccac

SEQ ID NO: 292573 - DNA, 2322 bp, Homo sapiens
aaatgccaggctggtacggcccgaggagtttatggatcaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292574 - DNA, 2470 bp, Homo sapiens
gtaaacactgaccctttccccctttgctgctacctaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292575 - DNA, 2109 bp, Homo sapiens
cggggcgcggagccccagccgagcctagccctgcccggccccggaggacttgcaacactccgaggccaggaacgctccgtctggaacggcgcaggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292576 - DNA, 2124 bp, Homo sapiens
tgggtgtgcgtgcccagatgagtagcagacccctagaactcgagagcaagagtgggacctgctggtggtggcgtgcacgctgcgctgcagcccccatgtcctctcagcccgtcagctgcagcctccccagacctccttcctggccggagcctggtgcttcagagcatctcagtgaccctggctgggggtaatctcgttcttgcttcctgttgagttgcttcccctcagacttccaaacggctatttgggccccaaatcactggcctggtgtgtgctgccaagcggggcagatttgggcctgaactgcttccccatctctttgtccctagtgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292577 - DNA, 1907 bp, Homo sapiens
ctgtgggtgagggctggggcacccggctgccgcatccagcagtgcccgggcaccgagacagctgagtaccagtcattgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292578 - DNA, 1529 bp, Homo sapiens
ttgctgaggtttcgtatacgaaattattctgtccccttcttctccaggtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292579 - DNA, 1546 bp, Homo sapiens
cgtcaagcgatcccccatcaagcagtagcagggattgtcactagcattgtgctctacttcatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292580 - DNA, 1480 bp, Homo sapiens
ataccggtgtaatagatgcaccgggagtatccgcatgaacttcactagcatctagagtgggcaggtacactggctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292581 - DNA, 1330 bp, Homo sapiens
gcggctggtacggtcgggggttttggatctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292582 - DNA, 2871 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaacccaaaaaaaaaacctcgtgccgaattcggcacgaggagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgactgctaagcctcttgccttgtctttagtagctaatgatcagagagatttttttttttaaactaccatggtcccaggattccatcctgaaatttatttttctttgtatgaatatgtgtaaatgatttaaaaataaaactgtaaaatatt

SEQ ID NO: 292583 - DNA, 2301 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292584 - DNA, 1132 bp, Homo sapiens
  misc_feature (12)..(12): n is a, c, g, or t
  misc_feature (18)..(18): n is a, c, g, or t
aggagagttaanccctgnggggtgggtttaacggggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292585 - DNA, 1420 bp, Homo sapiens
ataattcgcacttcgcccgacctaattcaccgcgctgactgatcatacttattatcgcccacggattctgccttatccttactattcgagttagcaaaatcaataatactaacgccctctacacacgaactcttaatcctctctcaaggtatttcagacatctactaccccaataattatactttccgattggacttctagcaagcctcgctatcctccccttaccccccactataaaccctactgggataactctctgttgcttagccaccaagttctccttgattcaaatatcactctcctagcttagcaggactcatccatagctagtcagcagtcctatactccctctagcagtatttccaggagacaaatgaggctcactcacccaacacattaacaagcataaaaccctcattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292586 - DNA, 1057 bp, Homo sapiens
aagcagtggtatcaacgcagagtggcattatggccggggggggcggggacctcgtgaccttgaagtcacttctacctttcatattcccttctagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292587 - DNA, 997 bp, Homo sapiens
  misc_feature (17)..(17): n is a, c, g, or t
  misc_feature (25)..(25): n is a, c, g, or t
ctactactactaaattngcggccgntcgacagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292588 - DNA, 948 bp, Homo sapiens
ggatgagtacgccttgacatcaaagagcccacaatcatgtcgaatgcttgtctgacagccactagaggggagaaaaatgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292589 - DNA, 892 bp, Homo sapiens
  misc_feature (45)..(45): n is a, c, g, or t
  misc_feature (88)..(88): n is a, c, g, or t
  misc_feature (122)..(122): n is a, c, g, or t
  misc_feature (130)..(131): n is a, c, g, or t
ccaccgcgggcacaggcggctgggacgacggagggggagcgaggntggcccctcagcaaagccagagagcgggggccccgtccgccgngacacagagtccagatctgggaggccgggggcgnggcagctnngagcgcaggaagggagaagagagcggggcccatggggcgccgggcggcaatcccggcgggggtcagggacagagggaggggggagcggggggagggacagataatagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292590 - DNA, 545 bp, Homo sapiens
tctagaggatcccaacgtcagcactccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292591 - DNA, 1785 bp, Homo sapiens
  misc_feature (1766)..(1766): n is a, c, g, or t
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataatagaacgagcaaagtaacctatacaggccaggggagatgctgttccatgctggtcgacgccggcccgaaaantttagtagttagtaagacg

SEQ ID NO: 292592 - DNA, 715 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacgaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292593 - DNA, 1371 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtggaggtatagggtggtatagggtggtatagggtggtatagaggtgtatggtggtatagagtgtatcagtgtgtaagcggccgaccc

SEQ ID NO: 292594 - DNA, 1180 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctgcttacgacacaccagctggtctgggcaccggaggccacataagccggggttacttactgggcctgcggtttcccggcgtctctcatttcccttggcggcgtggtggggtcccctaggggcgccctttcccggctgggtcctccacgaagggggcccggaggtggggtagccctcccctggaagcgggctgtgggaggctctccgggggtgtgggggcgcgccccctgggggggggagtccccggcaccccg

SEQ ID NO: 292595 - DNA, 980 bp, Homo sapiens
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggctcactacaactgcgctgcagtgagctacgatagtgccacggcactccaa

SEQ ID NO: 292596 - DNA, 1062 bp, Homo sapiens
  misc_feature (616)..(617): n is a, c, g, or t
  misc_feature (643)..(643): n is a, c, g, or t
cggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctctgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcggtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgatnnccatggaacatcatactgctgacccnttaaacctatatgccaatgggcattcatgacgggcaaccatttccagtatgtacacaccaaagccgatcatcattgcaatgatcatacaactgccggtggtaatccatatcagtcaaccatcattactggcttcaagaccaaaggtggcattcacctcgtgacgaggccactctgtgtcttgtggacttggtgcccctcgataacctggcataggtcacacagcactcgtgccctacgtcccaagagaccggcacgtgggacacccacaagggacaaaacgcagaccggagcagcccacagagccacccccggccccgggcgccacaagacacaccgcgcgccctggcgagccgcggagcgaacgatgacgccccgaggaataatacaaaggggcccccagcaaggacagccacggcaa

SEQ ID NO: 292597 - DNA, 282 bp, Homo sapiens
agctcggcacccgcttatctttctgctctgagctactaggggctgatttatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaaatttatgtctagaagttaaaaccc

SEQ ID NO: 292598 - DNA, 1303 bp, Homo sapiens
gagatagagccttgctctgtctcccaggctggagtgcagtggtgcaatctcagctcactgcaacctctgcctcccaagttcaagcgattcttctgactcagcttcctgagtagctgggattacaggcacccgccaccacgtccagctaatttttacatttttagtacagggtttcaccaccttggccaggctggtctcaaactcctgacctcaggtgaaccgcccaccttggactcccaaagtgctgggattacaggcgtgagccactgcacgcagcctacggatgccttttaaaggaaattcttatagaccccctaagaaaatgtctctgattccaacgaatcctgggactggacaattagataaacactgtcttaagaattagtactacgccttaaaaaaaaaaaaaggcttttcaattgtgaaacatcacagcaaaataagtttcatttttacaactagtaaaatattagactatcataattatcaaagttttatgattcatagaaaattgtgtatagactcagaatgagaaatctagtattaaaaaaaactgtgttgcttctactaagaaacactaatattttcccaataatcagacagtagacatctgttcttaacattagtatctttcagtgctaacacttaactattgtaagattgcaaatggctctgggcagggccaatagtcacactgctggcaaaagcaaagaaaaactaataatggacatggataaacaaaacaataatgctcaatgtcattcattcttcattcaactgcaaagataagttgaatgacaccactatcacttaaaacacaaaaaagggaaataccaatttaacaaataccttattttcacccagatatcaacaatgcgaaggaaaaatcagtatctcacatgactttgtagaaaacagactgaacaagtaactgcgttcccagtgaactatgagctactatgtgtggcacacgtcattttgtttacttaatgacatatgaaaaccgtaacatcttcatcctcgatgataataaaggcaatgtgctattgaatttcttaatcttccttaaccatatgctatggtttggatgtgtgtcccctgcaaatttcatgttgaaatgtgatccccaatgtcagaggtggggcctagtgggagatactgaatcatggggtagggggtggtcctctcatgagtccccatggtgattgataagtgtgttctcactcagttcacgtgagatctggttgtttataaaagtctgggacctcccattctctctcttgctccctttcgtcatgtgaca

SEQ ID NO: 292599 - DNA, 528 bp, Homo sapiens
ccctcccatcttctcccatgtgaggacacaccaagaaggcctcaccagacgtcaataccttgatcttggacttcccagcctcaagaagtatatcaacaatgcgaaggaaaaatcagtatctcacatgactttgtagaaaacagactgaacaagtaactgcgttcccagtgaactatgagctactatgtgtggcacacgtcattttgtttacttaatgacatatgaaaaccgtaacatcttcatcctcgatgataataaaggcaatgtgctattgaatttcttaatcttccttaaccatatgctatggtttggatgtgtgtcccctgcaaatttcatgttgaaatgtgatccccaatgtcagaggtggggcctagtgggagatactgaatcatggggtagggggtggtcctctcatgagtccccatggtgattgataagtgtgttctcactcagttcacgtgagatctggttgtttataaaagtctgggacctcccattctctctcttgctccctttcgtcatgtgaca

SEQ ID NO: 292600 - DNA, 2298 bp, Homo sapiens
ctccagagctttcgaaagggcacggaagtccccgtctaaacgcccgctgcaggcggctggtggtccagggaagcggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggtagagctggacgtacacgtctttgcgctgctccccggccggcagcgtcacattgttggcgaccaactcactcttcaacttgtcttttgtcaggaccgaggggtcttccaggaactccggcatctcggggatctgcgaagccccctccccacagcctttgccgccgccgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagcttgagaagcagctttcgtctctggggtcgatcgcctacgaacgcgccgaattccacgccagtgtgaggacccttggctgggcctttcttcctcccgggacactgaagctccaagagtagccgcagccttgccttccccaaacgctagccctgaaggggaagaaaagaagcgaggcttgtctgcaggcactcatattccttgatttgatttactttgggagggggagggcggggagttacccctctcctcgcgaacgcttcttttgttccagaaacccaggggaagccagacctctaccatcgggcacttaaattacccttgaatttgtgacaaaagtgtactataccattcacttcttagtgtcatagttggggcatgtctaaattgtttaatttgaacagtgcgttcagacgcaagacaaattcgcgcttgcatttttgttgaaaccgtctctggctttggatcccaccacccgcaagaatcctaaacctaacgtttgataacaaaacgaaggagaacccttgggaaccccctcaatggtcaatttaaaataacagatggtgcataatcctaaaggaagactagtgacctataattaggcctagaaccctaatcaaacccgtattaccgatccaaattaaaacctggtagaatctaatacattgactgcaattaaaatgtttgcctggaaattagtatcactgatgacaaatatttgtatttctgatgaatatgtatgtttaaagatgctttctttctagaaaggaaaggagaccttggatgtagggtgtgttaatcatttccccagaatctgagctccaaactatgttttagaaactggttaaattttttttaaatgtttgcctgctttctacattgctaggttagaatacatttaaaacaaacgccttcactaaaaatgtttcctatgatttaagcgacttacttttattcaaattgcgatattatttcttttagtgataattattttcctagaggtaactaattcctttataaaaatctcagtattcacatacatttaagcaatggtattaagctcaataatgcaaattaaaaatcaggttttaattagcaagttgttaggtaggtttttatgatcccttgtaaaagttg

SEQ ID NO: 292601 - DNA, 1860 bp, Homo sapiens
ctccagagctttcgaaagggcacggaagtccccgtctaaacgcccgctgcaggcggctggtggtccagggaagcggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggtagagctggacgtacacgtctttgcgctgctccccggccggcagcgtcacattgttggcgaccaactcactcttcaacttgtcttttgtcaggaccgaggggtcttccaggaactccggcatctcggggatctgcgaagccccctccccacagcctttgccgccgccgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagcttgagaagcagctttcgtctctggggtcgatcgcctacgaacgcgccgaattccacgccagtgtgaggacccttggctgggcctttcttcctcccgggacactgaagctccaagagtagccgcagccttgccttccccaaacgctagccctgaaggggaagaaaagaagcgaggcttgtctgcaggcactcatattccttgatttgatttactttgggagggggagggcggggagttacccctctcctcgcgaacgcttcttttgttccagaaacccaggggaagccagacctctaccatcgggcacttaaattacccttgaatttgtgacaaaagtgtactataccattcacttcttagtgtcatagttggggcatgtctaaattgtttaatttgaacagtgcgttcagacgcaagacaaattcgcgcttgcatttttgttgaaaccgtctctggctttggatcccaccacccgcaagaatcctaaacctaacgtttgataacaaaacgaaggagaacccttgggaaccccctcaatggtcaatttaaaataacagatggtgcataatcctaaaggaagactagtgacctataattaggcctagaaccctaatcaaacccgtattaccgatccaaattaaaacctggtagaatctaatacattgactgcaattaaaatgtttgcctggaaattag

SEQ ID NO: 292602 - DNA, 2205 bp, Homo sapiens
ctccagagctttcgaaagggcacggaagtccccgtctaaacgcccgctgcaggcggctggtggtccagggaagcggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggaccgaggggtcttccaggaactccggcatctcggggatctgcgaagccccctccccacagcctttgccgccgccgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagcttgagaagcagctttcgtctctggggtcgatcgcctacgaacgcgccgaattccacgccagtgtgaggacccttggctgggcctttcttcctcccgggacactgaagctccaagagtagccgcagccttgccttccccaaacgctagccctgaaggggaagaaaagaagcgaggcttgtctgcaggcactcatattccttgatttgatttactttgggagggggagggcggggagttacccctctcctcgcgaacgcttcttttgttccagaaacccaggggaagccagacctctaccatcgggcacttaaattacccttgaatttgtgacaaaagtgtactataccattcacttcttagtgtcatagttggggcatgtctaaattgtttaatttgaacagtgcgttcagacgcaagacaaattcgcgcttgcatttttgttgaaaccgtctctggctttggatcccaccacccgcaagaatcctaaacctaacgtttgataacaaaacgaaggagaacccttgggaaccccctcaatggtcaatttaaaataacagatggtgcataatcctaaaggaagactagtgacctataattaggcctagaaccctaatcaaacccgtattaccgatccaaattaaaacctggtagaatctaatacattgactgcaattaaaatgtttgcctggaaattagtatcactgatgacaaatatttgtatttctgatgaatatgtatgtttaaagatgctttctttctagaaaggaaaggagaccttggatgtagggtgtgttaatcatttccccagaatctgagctccaaactatgttttagaaactggttaaattttttttaaatgtttgcctgctttctacattgctaggttagaatacatttaaaacaaacgccttcactaaaaatgtttcctatgatttaagcgacttacttttattcaaattgcgatattatttcttttagtgataattattttcctagaggtaactaattcctttataaaaatctcagtattcacatacatttaagcaatggtattaagctcaataatgcaaattaaaaatcaggttttaattagcaagttgttaggtaggtttttatgatcccttgtaaaagttg

SEQ ID NO: 292603 - DNA, 1986 bp, Homo sapiens
ctccagagctttcgaaagggcacggaagtccccgtctaaacgcccgctgcaggcggctggtggtccagggaagcggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggcgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagcttgagaagcagctttcgtctctggggtcgatcgcctacgaacgcgccgaattccacgccagtgtgaggacccttggctgggcctttcttcctcccgggacactgaagctccaagagtagccgcagccttgccttccccaaacgctagccctgaaggggaagaaaagaagcgaggcttgtctgcaggcactcatattccttgatttgatttactttgggagggggagggcggggagttacccctctcctcgcgaacgcttcttttgttccagaaacccaggggaagccagacctctaccatcgggcacttaaattacccttgaatttgtgacaaaagtgtactataccattcacttcttagtgtcatagttggggcatgtctaaattgtttaatttgaacagtgcgttcagacgcaagacaaattcgcgcttgcatttttgttgaaaccgtctctggctttggatcccaccacccgcaagaatcctaaacctaacgtttgataacaaaacgaaggagaacccttgggaaccccctcaatggtcaatttaaaataacagatggtgcataatcctaaaggaagactagtgacctataattaggcctagaaccctaatcaaacccgtattaccgatccaaattaaaacctggtagaatctaatacattgactgcaattaaaatgtttgcctggaaattagtatcactgatgacaaatatttgtatttctgatgaatatgtatgtttaaagatgctttctttctagaaaggaaaggagaccttggatgtagggtgtgttaatcatttccccagaatctgagctccaaactatgttttagaaactggttaaattttttttaaatgtttgcctgctttctacattgctaggttagaatacatttaaaacaaacgccttcactaaaaatgtttcctatgatttaagcgacttacttttattcaaattgcgatattatttcttttagtgataattattttcctagaggtaactaattcctttataaaaatctcagtattcacatacatttaagcaatggtattaagctcaataatgcaaattaaaaatcaggttttaattagcaagttgttaggtaggtttttatgatcccttgtaaaagttg

SEQ ID NO: 292604 - DNA, 2334 bp, Homo sapiens
ctccagagctttcgaaagggcacggaagtccccgtctaaacgcccgctgcaggcggctggtggtccagggaagcggcgtcgactgcgtgcaaaacaaccgccgccaacgcaactccacacctcccagacccacacgtcaaagaacgcgaaccccgcggccccaacttctggcctctccgctccggcgcctgcagccccgcggggaaggggcgacgcgagggggcgcagggacagccccgcacctgggaggcccgagggggcgcccgggagggaggggctgcaaacggcggcgagcgcgcgcggcaaccgccaaacgcccgcctttgtagccccggccccgcgtccttaccctgccgacggctgctcggctccggcccgcggcggcggccccagagccgaggaccggggtgggctcgcgctcttcgtcactggagaagtccgggggccccttgctgttggtgccggcggggagcggcggccggttgcgagccgtgaggtgctgcaggtagagctggacgtacacgtctttgcgctgctccccggccggcagcgtcacattgttggcgaccaactcactcttcaacttgtcttttgtcaggaccgaggggtcttccaggaactccggcatctcggggatctgcgaagccccctccccacagcctttgccgccgccgctcacgccggcgcgcttgctcctggccggggaccgcgctgccgcctccgagcctcacggctcctgcccgggaagagcgctgcggagcggaacaaaaactcgcggacacaaagccaagccagacccggacacaaaagaccccagagccgaactacgaaccaactgcggccaagctggaagctcgcaccaaccccagcccacacactacaggcaggaggcgagcagcctgcttcgcccacgccccaagaacgcgcgccgccattggcgggcgacgggaggaagcgcggcggtgattggcgagacggctcgcgcgggttccattagccgccgcgctgagcgagaggaggtagaaacgcagtttaaaaggcgctggggcgggagccgaggctcccggcccgcttctgttttcgttttctccacccttccccttagacgccgataagggacaggtcgtactgcttttgtgcgccgtttcctctccctcccccagccgaactacgaaccaactgcggccaagctggaagctcgcaccaaccccagcccacacactacaggcaggaggcgagcagcctgcttcgcccacgccagtgtgaggacccttggctgggcctttcttcctcccgggacactgaagctccaagagtagccgcagccttgccttccccaaacgctagccctgaaggggaagaaaagaagcgaggcttgtctgcaggcactcatattccttgatttgatttactttgggagggggagggcggggagttacccctctcctcgcgaacgcttcttttgttccagaaacccaggggaagccagacctctaccatcgggcacttaaattacccttgaatttgtgacaaaagtgtactataccattcacttcttagtgtcatagttggggcatgtctaaattgtttaatttgaacagtgcgttcagacgcaagacaaattcgcgcttgcatttttgttgaaaccgtctctggctttggatcccaccacccgcaagaatcctaaacctaacgtttgataacaaaacgaaggagaacccttgggaaccccctcaatggtcaatttaaaataacagatggtgcataatcctaaaggaagactagtgacctataattaggcctagaaccctaatcaaacccgtattaccgatccaaattaaaacctggtagaatctaatacattgactgcaattaaaatgtttgcctggaaattagtatcactgatgacaaatatttgtatttctgatgaatatgtatgtttaaagatgctttctttctagaaaggaaaggagaccttggatgtagggtgtgttaatcatttccccagaatctgagctccaaactatgttttagaaactggttaaattttttttaaatgtttgcctgctttctacattgctaggttagaatacatttaaaacaaacgccttcactaaaaatgtttcctatgatttaagcgacttacttttattcaaattgcgatattatttcttttagtgataattattttcctagaggtaactaattcctttataaaaatctcagtattcacatacatttaagcaatggtattaagctcaataatgcaaattaaaaatcaggttttaattagcaagttgttaggtaggtttttatgatcccttgtaaaagttg

SEQ ID NO: 292605 - DNA, 2544 bp, Homo sapiens
cacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaaagacaaaacaaaagacaaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatcttaaggccttg

SEQ ID NO: 292606 - DNA, 696 bp, Homo sapiens
  misc_feature (696)..(696): n is a, c, g, or t
cttgctgccggggtcttgctgccggggaggccagtcctggtgggggaggctcagtgactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaacaaaaaacaaacccgagaacatagcttctcttcctcttaagaaacccaacctcccgaaccagcaacattgcataacaacttacacacacttccaaacgccgaaacctaccctattacctcaagtgtgaccgcaaataacttgggaccacagcggcaaccaagttatacccatagggcaataagacagcgcaactcctatatacttaaagtcaccatatattcgacaccacacaaggggcgtaaacaagacccacacagaatgcacggcgactcagagagaactcccgaatttggctccacgccagcaatataaaggcgtaacgcacggaacacccgaattaacaagcctacgatgaactagagataaaaccgagaaaaaacaaggccgggaaccaaccn

SEQ ID NO: 292607 - DNA, 336 bp, Homo sapiens
gggccccgcggggccgcgcagggggcgtcctcaaccccgcgcccgctccctctttccatcccctcccttcatcctgttatttattcggaaggtttcaaatcacgacagagtccatgttggaggtgataaaaaactgtaaaaaaaaaaaaaaaaaaaaaagacaaaacaaaagacaaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatcttaaggccttg

SEQ ID NO: 292608 - DNA, 2195 bp, Homo sapiens
cacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacacctctattaatgaggatgataagactgttgtcccaatgaactagaaggggcatatggagctctgaaatctactgaagatttgcttgtagcaaggttcctgggttctgttacttgatgcttggataggaatgaaatgccttttcgat

SEQ ID NO: 292609 - DNA, 1292 bp, Homo sapiens
  misc_feature (8)..(8): n is a, c, g, or t
  misc_feature (16)..(17): n is a, c, g, or t
  misc_feature (37)..(37): n is a, c, g, or t
cttctgtntgtctttnnctgtcgcttttttgattttnttcttttttgttccttgcagcagaagaggaaaaaaaagcaacaaaaaaagaaaacacacagaagagatttaaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaaagacaaaacaaaagacaaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatcttaaggccttg

SEQ ID NO: 292610 - DNA, 814 bp, Homo sapiens
agcgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccaggtaaaccggctgccggcgctgtccacttccctctgactcccgcctccgcaggcgttctcaccccttccaggactcgactgcagttttctcactgtccccggcttctcatgaactccgtataccccctcccagacattttcccgtccggatccatctctccgccacatcacctctcatttcccccagaactcagctcctttgtgaaacctttcttgccgaactctaacaactaaatctccccgggagcctgctccgaactgaactgttctggttgctagattgcttacgggctgtcttattgcaacaaaggagaccagataccgaaaaaagatttctgagctattgccttcttcaaggaacgttttctgatatttacagtttattgttttcacaggctggaacggtttttaggcattttggcttcttatttagagagggctcctatttccttcatagacgcatagttttttagagcaggaaattgaccttgttcaacccgcaggttaattaaaaatttaaaaattaattctaaatta

SEQ ID NO: 292611 - DNA, 4299 bp, Homo sapiens
  misc_feature (3934)..(3935): n is a, c, g, or t
  misc_feature (3984)..(3984): n is a, c, g, or t
  misc_feature (4019)..(4019): n is a, c, g, or t
  misc_feature (4030)..(4030): n is a, c, g, or t
  misc_feature (4036)..(4036): n is a, c, g, or t
  misc_feature (4038)..(4039): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292612 - DNA, 4255 bp, Homo sapiens
  misc_feature (3890)..(3891): n is a, c, g, or t
  misc_feature (3940)..(3940): n is a, c, g, or t
  misc_feature (3975)..(3975): n is a, c, g, or t
  misc_feature (3986)..(3986): n is a, c, g, or t
  misc_feature (3992)..(3992): n is a, c, g, or t
  misc_feature (3994)..(3995): n is a, c, g, or t
agcgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccagacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292613 - DNA, 4243 bp, Homo sapiens
  misc_feature (3878)..(3879): n is a, c, g, or t
  misc_feature (3928)..(3928): n is a, c, g, or t
  misc_feature (3963)..(3963): n is a, c, g, or t
  misc_feature (3974)..(3974): n is a, c, g, or t
  misc_feature (3980)..(3980): n is a, c, g, or t
  misc_feature (3982)..(3983): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292614 - DNA, 4132 bp, Homo sapiens
  misc_feature (3767)..(3768): n is a, c, g, or t
  misc_feature (3817)..(3817): n is a, c, g, or t
  misc_feature (3852)..(3852): n is a, c, g, or t
  misc_feature (3863)..(3863): n is a, c, g, or t
  misc_feature (3869)..(3869): n is a, c, g, or t
  misc_feature (3871)..(3872): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagaagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292615 - DNA, 2828 bp, Homo sapiens
  misc_feature (2463)..(2464): n is a, c, g, or t
  misc_feature (2513)..(2513): n is a, c, g, or t
  misc_feature (2548)..(2548): n is a, c, g, or t
  misc_feature (2559)..(2559): n is a, c, g, or t
  misc_feature (2565)..(2565): n is a, c, g, or t
  misc_feature (2567)..(2568): n is a, c, g, or t
ctgatcggacatggtacattcttgagagccactaacaatatggaacaggatcacacatctgctcccttattgttaaagatgagaaaaccctcggagagaagccctttaaatgtgaagagtgtgggaaggccttcaggcacacctccagcctctgcatgcatcaaagagtccacacaggagagaaaccctataaatgttatgagtgtgggaaggcgttcagtcagaagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292616 - DNA, 4244 bp, Homo sapiens
  misc_feature (3879)..(3880): n is a, c, g, or t
  misc_feature (3929)..(3929): n is a, c, g, or t
  misc_feature (3964)..(3964): n is a, c, g, or t
  misc_feature (3975)..(3975): n is a, c, g, or t
  misc_feature (3981)..(3981): n is a, c, g, or t
  misc_feature (3983)..(3984): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaaagcaaccaatttttaactttctcttctcattcctgttttcattgatttcccacatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292617 - DNA, 4245 bp, Homo sapiens
  misc_feature (3880)..(3881): n is a, c, g, or t
  misc_feature (3930)..(3930): n is a, c, g, or t
  misc_feature (3965)..(3965): n is a, c, g, or t
  misc_feature (3976)..(3976): n is a, c, g, or t
  misc_feature (3982)..(3982): n is a, c, g, or t
  misc_feature (3984)..(3985): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagaaaataaactagggtgatgattttagtggtggggtggggtgggggtggggtgacattagctagtggtcagggaggcctttccgcggtgggatgttgagctgaggccggaggagaagtagcagtcgctggcagagcacacaggctgctctgggggatgagctggtgcgtttaaggaacaggccagcactggcattcgcaagcagtggggaaggggagagatgccgaggtggtcagtatcctgactttcagaggcctttttttgtttgttttaatttttgctagattgatattaaaaactcatgtggaggaactcaaggaatgtttagaagaccaaaagtccccaatgacaggaacaaatgtagtccttttgctcaggaagtctttggggaaattaaggatctttgaagctctgaaataggtgatcaggttagtggtgtctgtcagctgtctaagaggttggaaaatgaactactcaagatagtcacgaaaatactgaaagtttgatttttctttccatatttgaattaattttttctgtttgactggaaggggtttttgtataactaaaacctcagcgcataaaggagatttaaaaggagcacatgatttagtgggtgggccatgaaactagagatgggatttgggggtgaatttgtcaatatctggattttaatccagacatctctgctaacaagcctttggtaagtcacttcagatacttttcctcctttttacaaagagagggctggcttagttatttgccaaagccccttccaggcctgaattccacaagtacgatttactgtagtgtcttatcactctttcatgtcacaatagcgtggagcattagagaaaagcctagacttttagttgatagccagttgaaatatcattgatnngaattttagttttaggaaaaatgggttgatttctagctttattactatnaggtatgtgagcttgggcaaatcgcttaatcttgnggtctagtttnctctcnannatgagaacattaggctaaatgatttcccgagttccagctagtcctaggagttctataatttctacattagttgaacttatttcatcatgctgtttgctggggaatatgactaaccccttttgaagctactaatttaatgtcgagcttaaaggccataattgtatttcagaacatattattgacttacggttgtccaatcaatttataaatcgtttttaccggaaaaaaacacaaaaaaaaaatttggggcccccaaaatt

SEQ ID NO: 292618 - DNA, 3500 bp, Homo sapiens
  misc_feature (2996)..(2996): n is a, c, g, or t
  misc_feature (3002)..(3002): n is a, c, g, or t
  misc_feature (3103)..(3104): n is a, c, g, or t
  misc_feature (3117)..(3117): n is a, c, g, or t
  misc_feature (3151)..(3151): n is a, c, g, or t
  misc_feature (3159)..(3159): n is a, c, g, or t
  misc_feature (3175)..(3175): n is a, c, g, or t
  misc_feature (3191)..(3191): n is a, c, g, or t
  misc_feature (3193)..(3193): n is a, c, g, or t
  misc_feature (3201)..(3202): n is a, c, g, or t
  misc_feature (3214)..(3214): n is a, c, g, or t
  misc_feature (3221)..(3221): n is a, c, g, or t
  misc_feature (3231)..(3231): n is a, c, g, or t
  misc_feature (3242)..(3242): n is a, c, g, or t
  misc_feature (3247)..(3247): n is a, c, g, or t
  misc_feature (3255)..(3255): n is a, c, g, or t
  misc_feature (3259)..(3259): n is a, c, g, or t
  misc_feature (3269)..(3271): n is a, c, g, or t
  misc_feature (3279)..(3280): n is a, c, g, or t
  misc_feature (3282)..(3283): n is a, c, g, or t
  misc_feature (3291)..(3291): n is a, c, g, or t
  misc_feature (3319)..(3319): n is a, c, g, or t
  misc_feature (3321)..(3321): n is a, c, g, or t
  misc_feature (3341)..(3341): n is a, c, g, or t
  misc_feature (3348)..(3348): n is a, c, g, or t
  misc_feature (3352)..(3352): n is a, c, g, or t
  misc_feature (3356)..(3356): n is a, c, g, or t
  misc_feature (3371)..(3371): n is a, c, g, or t
  misc_feature (3379)..(3379): n is a, c, g, or t
  misc_feature (3415)..(3415): n is a, c, g, or t
  misc_feature (3417)..(3417): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagcccccccctccccncccccnccccccccccccccccccccccccccccccccccccccccccccccccccccccccccccccccccccccccccccccccccccccccccccccccccccnnccccccccccccncccctcccctcccccccccccctccccccccccncccccccncccttctttcttcttntcttctttctttcttntntcctcttnnttttttctttcnttttttnttctctttcnttttctctctncttcncttttttntttnttttctttcnnnttttttcnntnntttcttcncctttttctctcttttctttctcttttntntttttcttcttttctttccnttttttntctntttnctcttctcctttttnctttcttnttttcttcttttcttttttcttctttttccttttcntnttctttttctttctctttcctttcttttttcttctcttttcttctcttttctcttctcttcttctctttctcttttttttcct

SEQ ID NO: 292619 - DNA, 3320 bp, Homo sapiens
  misc_feature (2995)..(2995): n is a, c, g, or t
  misc_feature (3011)..(3011): n is a, c, g, or t
  misc_feature (3013)..(3013): n is a, c, g, or t
  misc_feature (3021)..(3022): n is a, c, g, or t
  misc_feature (3034)..(3034): n is a, c, g, or t
  misc_feature (3041)..(3041): n is a, c, g, or t
  misc_feature (3051)..(3051): n is a, c, g, or t
  misc_feature (3062)..(3062): n is a, c, g, or t
  misc_feature (3067)..(3067): n is a, c, g, or t
  misc_feature (3075)..(3075): n is a, c, g, or t
  misc_feature (3079)..(3079): n is a, c, g, or t
  misc_feature (3089)..(3091): n is a, c, g, or t
  misc_feature (3099)..(3100): n is a, c, g, or t
  misc_feature (3102)..(3103): n is a, c, g, or t
  misc_feature (3111)..(3111): n is a, c, g, or t
  misc_feature (3139)..(3139): n is a, c, g, or t
  misc_feature (3141)..(3141): n is a, c, g, or t
  misc_feature (3161)..(3161): n is a, c, g, or t
  misc_feature (3168)..(3168): n is a, c, g, or t
  misc_feature (3172)..(3172): n is a, c, g, or t
  misc_feature (3176)..(3176): n is a, c, g, or t
  misc_feature (3191)..(3191): n is a, c, g, or t
  misc_feature (3199)..(3199): n is a, c, g, or t
  misc_feature (3235)..(3235): n is a, c, g, or t
  misc_feature (3237)..(3237): n is a, c, g, or t
agcgcgcgctgtcccccggaggcgtctgggtgtgcggagcgcgcgcgcgcgcggctcggaggcgcacctgtgaggtgtccctgaggagagggagggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgacctgcaaatccaagagacacatctttggaagataagagagcttcttcaagaccaaaaaaggagacggcatgatacccatgtagggaattccccaaagcagggcttgccatacctggaccccgaggagcctgcttgctggaaaggctttcctgtctgatgtgcaggaggcagaatgccaaactgactcttcaaggggcaactgcaggggctcgagaccagccagcagtatctcatccttcgatacaggggatatactgtacagtcctttttctagaagtgagacatacaagattactctacaagaggaagattccaggggctcaaaaacgcaaaggtttgcactttgagagccccttggaatgttgacaactcaggatctaaaacaaagttctgtgttaatgagttacagaattcacgtggaagtcaatgtcactttataatcgataataatactgagtgaggaacactatgcaggaagaaaccttccgtagaaagacaggcagggaaaagcttaggctgaccttaaacttacctaatagagcaagcctgagatagactgccaaaatggccaaataagagactctatgaaataacagtcttgtaactgtagtaatcataaggaaattttctccttgaaatcacgataccaaataggaaaaatgatctacaagtgccccatgtgtagggaatttttctctgagagagcagatctttttatgcatcagaaaattcacacagctgagaagccccataaatgtgacaagtgtgataagggtttctttcatatatcagaacttcatattcattggagagaccatacaggagagaaggtctataaatgtgatgattgtggtaaggattttagcactacaacaaaacttaatagacataagaaaatccacacagtggagaagccctataaatgttacgagtgtggcaaagccttcaattggagctcccatcttcaaattcatatgagagttcatacaggtgagaaaccgtatgtctgtagtgagtgtggaaggggctttagtaatagttcaaacctttgcatgcatcagagagtccacaccggagagaagccctttaaatgtgaagagtgtgggaaggccttcaggcacacctccagcctctgcatgcatcaaagagtccacacaggagagaaaccctataaatgttatgagtgtgggaaggcgttcagtcagagttcgagcctctgcatccaccagagagtccacactggagagaaaccctatagatgttgtggatgtgggaaggccttcagtcagagttcgagcctgtgcatccaccagagagtccacacaggagagaaacctttcaaatgtgatgagtgcggaaaggccttcagtcagagtacgagcctctgcatccaccagagagtccacacaaaggagagaaaccatctcaaaatatcagttatataaaacgttttgctaagagtttaaaatcttaaaacccataagtgccactaggaaggaaaccctgtatatacctacattgacccaagaaatatttacgcaatccctagcagaacattgtttctgaggaggcatatgtgagattgatttgttggttcatgccaagtgtgttccacaggttgactttgaatgtggacctctgagcatccacgcaggatggctctcaggtcccagtcacagacgtcgcttcctgggattccagcacgatgcctccatagttgaaagactacacaaaaagccacaatcattgcccggcctcctgagtcaccttctatctatactttgcttaaaagctatcccagatactcccccttgaggagctcatgcccttccttcctctttattcgagcatactggcaatgcattggaaaacagacagctcccactaagatcacgttctggtatttctgaggttaacacttgatttagcccctacatatctttccatatatcctattatttctgaatatatgtcctcaaaatccccataaatatccatcccttcctagatggcattaactttcattttagattttaggtgactcataattcccattcacttagcctatcagaaaagtcattggcagacatatatgtccttgaaccttttttatttgtgtggattctgctcatcactgtctctgttagacttattttgtagtggctgcatcacatatttttcacttgaatttttttggaaatagctgaatgtaaatagcagggaggaagaagcaagcaaagtgagagcttttcttcatccagaattgccctctgggctcctttggtaacagatggagctccttcctagctagggagaccttatgagaagtggatggtaggaggagtcactaatgtttcaatctctatttctgtaatcttgggcaataatgcataggagttcttgataccccttcattgattactgtgtatcagttctttgttaggcatgaacgtctttattaatccatcattcttttcttcattcaacaaatatgtattgaacacctcctatatgccaggcactgtgctaggtgctgggaataccactgatgagacagacaaggtccctactcttgtggagtttacttctggtggaggagacagatgataagtaaacaaataaataatgtagtttgagatagtgattaagtgctatgaagttctttcttcttntcttctttctttcttntntcctcttnnttttttctttcnttttttnttctctttcnttttctctctncttcncttttttntttnttttctttcnnnttttttcnntnntttcttcncctttttctctcttttctttctcttttntntttttcttcttttctttccnttttttntctntttnctcttctcctttttnctttcttnttttcttcttttcttttttcttctttttccttttcntnttctttttctttctctttcctttcttttttcttctcttttcttctcttttctcttctcttcttctctttctcttttttttcct

SEQ ID NO: 292620 - DNA, 702 bp, Homo sapiens
agcgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccaggatcctaaggcctttgtagtccttcagccactgtgggccctgcctctgcctgttcttctggaatgtcttgggggttttgatcctgtcactgtgatcggtgttgctggaagtcggtccaggagctttttggataatccacctcatgactggaaaacaacgaagaaacccagtagcttcttcgccgtgtggattcagaccccgggagcccaggcctgcacctgggcagctgctccctgcacgtggccggacatatggaatatggagccccgctgccttggagtcagagagctgccaagtagaatttgcatgtaatgctgctatcattttcaattgctctcccaataaaacaggccctggagccgaggtgaatgccgtagaaggcattttttccactgggtgtgggtccagaataaataatcaaaag

SEQ ID NO: 292621 - DNA, 491 bp, Homo sapiens
agcgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggaggcgccctgcgtccggcagaggaggcgagcatcccgctcaggtgatgaggaacccctcgcgcacccagcgcagaaggctgctgccgccggacgcctccattgtttgaccacaacaagggccggattctcacccaggccgcacttggtgagagtcttcacggaccacagtgttgcacgaggtgattgtgtttgcagaggtttttttgtccttgaagagcacttagggctggagagcaagacacatgctgacgagcagaagctgacaggcttgctgccatgtgggaaagtccttggacgagttgtctgcttgcggagaggtgtctgcggctcaggtagggtgtcccagct

SEQ ID NO: 292622 - DNA, 491 bp, Homo sapiens
cacactgtcagggaaatgtatgtctccttaggcttaaaagcatttttttttttaaatgagaaatggagctttggaataaatatttttcattgctcacgacacggagcccctgggtcaccatggcctgtgttcttttaagtcatgtaaaactagtttctgctgagaacattcaaatgtttcaccttgtgctgaggaatttggaactaatcttctcagatcggtgttgctggaagtcggtccaggagctttttggataatccacctcatgactggaaaacaacgaagaaacccagtagcttcttcgccgtgtggattcagaccccgggagcccaggcctgcacctgggcagctgctccctgcacgtggccggacatatggaatatggagccccgctgccttggagtcagagagctgccaagtagaatttgcatgtaatgctgctatcattttcaattgctctcccaataaaacaggccctggagccgaggtga

SEQ ID NO: 292623 - DNA, 316 bp, Homo sapiens
ggaggcgggcggtgggggcgcgggccgggtggccgcgcatgcgtgcggcccccgctcccccggggcttccccggcctcgtgcgtgcgcagcgcgcgctgtcccccggaggcgtctgggtgtgcggagcgcgcgcgcgcgcggctcggaggcgcacctgtgaggtgtccctgaggagagggaggtgggtgcgcggcgcccgcggcctggggcgctgactcccctcacttggagtgagttctcggcggccgggctgcagtctttctttctttcccggagggaggcgggggccgggggccagggagcgggctgggggtg

SEQ ID NO: 292624 - DNA, 7209 bp, Homo sapiens
  misc_feature (4612)..(4612): n is a, c, g, or t
  misc_feature (7144)..(7144): n is a, c, g, or t
  misc_feature (7181)..(7181): n is a, c, g, or t
  misc_feature (7189)..(7190): n is a, c, g, or t
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccnagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtatacttcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagaggtaaaagaatgtacagtataataagggatagcaaggtgttttcctccatttaaaaaaaaaaaggtataatttacatacaataaacttcacctcttttatcttcatttttctttatttcttcttttttttttggagacagtcttgttctgttgcccaggcaagagtgcagtggtatgatctcagctcactgcancctctgccacccagattcaacagattctcctgcctcngcctgccnngtagctgggactacaggca

SEQ ID NO: 292625 - DNA, 5756 bp, Homo sapiens
  misc_feature (757)..(757): n is a, c, g, or t
aaataaataaaataaataaaaaataaaatacaataacaaggcacgtgctaccacacctggctgatatttgaaatattttttaatatagtagttctcactttgcgtaggactatgttaactcaacttgagcttattggagctgtatctttgctttatttgacttttggttacacagtaccctgcatagcaaggattgcctatataaattttaatgaaagctaattcctaaatattagtattattttacgcatgtttgatttgtgaaccacatttaataatttctcattttgaagccttttctttttttgaaacagagctttgctctgtcacccagtctggagtgcagtggtgtgattccacctcccgggttcaagtgattcttttgcctcagcctcctgagtaggtgggattataggcctgcaccaccatgcccagctagtttttgtatttttagtagagatgggatttaaccatgttggccaggatgttccaaactcctggcctcaagtgatctgcccgccctggcttcccaaagtgctgggattacaggcgtgagccaccttgtccggccttcattttgaaacttcttgagcatgttcctaagcgtgtaaatttgtggctgctgctttctctggaggtacagtttttataacatgatgcaagatggatcatagaaaagctaatgtagcagtttgtattactctataatgtgaagcagcatcttgcaaaatggtgattttgtgtgtttaacattttnaaaaataattataaaatatatatcattaggaattcttttctctctgaaatattttcttttttttagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcaggtatgtatttttctgtcctttaaaagttttttgaatgcttttttcagaggaaataaataattccatgattattttgtccttaagtccaacaacacttaaaaatctctaaaagtctaaagtcttttgtagccctaagtttctatgtttcagtgccttgaagaaactgtatgttcttttttaaaaagataactttaggctggtcttgaactgagctcaggtgatccacctgccctggcctcccaaagtgctgggattacaggtgtgagtcacagcgcccagcctcatgcagtatttttctttctgtgactggcttatttcacttaatgtaatgtcctcaaggttcatccatggtgtagcatatgagaagatttccttttttatgagcaaataatattctagtacatgtatagaccacattttctttatggacatttaggttgtttttgtctgttggcatcactgaacatgggagtgcaaatatctctttgagatcctgatttcagttcttgtggataaatacccagaagtggggttgctagatcatatggtagttctacttttaattttttgaggaccctccatactgtttccaatagcgggtacaccattttacataaccaccaacaatgtacagggttccagtttttttcacatcttcttcaatacttgttatcttttattttattaataatgtccttctgaacaggtagaaggtggtttcttatggttgttttgatttgcatttcccggataattattgagttgagcatctttcatagctgttagccatttgtatatcttctttggagacatgtctattcaggtcctgtgcccaattttttaattaggttattttcttttttgctattgagttttgagaattatttatatagtttggattttaggaccttatcagaaatatgatttacacattttctcccattccataggttgccttttcactctgctgtttcctttggcgtacagaagttttttagttcaatgtagtcccatttgtctaattttgcttttgttgcctatacttttggtgtcatatctaagaaactgttgccaaaaacaaacttaaagctgtttactatttttaagcatacaatttagtggcattatttacatttacattgttgtgcagccatcagcactatttctaaagctattttatcactgcaaacagaaaacctgtacccattatgcagtaattcctcattctcccctccctgcaaccactgataatctctaatctgctttctgtttctcatccaagtattaatcaggaccagacttgcttagtttgagatcaaattaggctcattgagagcggtaaggatgtagacaactttctgtctctatgactctgtctaatctagatattcacataagtggaatcatatgctatttctcatagttgtttgttcctaggtgacagataatctaaagtgtgagttcagagatacacctaatttcataaactacacaaaactgtactcgtgactttttctaatttttaaaataattaaaaaatgttgtgacagggtcttactctgttgctcaggctagagtgtagtagcgtgatcacagctcaccacaaccttgaactcttgggctcaaatgattctatcacctcagcatctcgagtagctgggactacagtcatgggacaccatgactggctaattttaaaaacattttttagtagagatgttttccaggctggtctcaaactcctgggctcaagcaatcctcgcacctcagcatgagccactgtgtctggccctagctttttctaatttaggggaaaaacaaccttgtaatgactgttaaagtcccagttggttttggaaaacaaagagttgattctaaaattgtcatgtacacaagaacaaaggctcaagaatggtaaagacagttttaaaaaacaccaactttgcagagggactgtgctagtagactaattttcgagctagagtaactaaagcagcatggtattggtgtagggttagatgaattgactcactggaactgaatatagagtttaggaagagacatttaggaatctgttatatggcagaggtagctttagaaattagcgggcaaagatagaactaacttcattagattgagctgagatttgaaaaacataatatttgatccttgtgttaccatatccgctaacttcctgatggattgaagactacatgtataaaacaaatctttacaacttttagaagaaatgtagaaaaatatctttgtaatgtgaaggcctcaggtaagacatttctattaagacgtagaaaacacagactttaaaagataagattgataagtttgatggtagtaaaattaaatacttctgttaacaaatcctccataaagaaaataaaaggcaagttactgatcgggagattttatgtgtaatatctagacaataaaaatatatagagaactcttgctgataagtcaggaaaacataaacacctagtagaaaaaatgaacaag

SEQ ID NO: 292626 - DNA, 400 bp, Homo sapiens
cccaagtagctgatattacaggcgcccaccaccacacctggctaatttttgtatttttagtagagacaggtttaaccatgtcggccaggctggtctcgaacttctgacctcaaatgattcgcccgcctcggcctctcaaagtgctgggattacaggtgtgagccactgcgcccgggcggattatgtcttttcaggaaacttgtgaattatttcatattccaaatggtttacttattcatgccagggagaaggaaattggtgacttcaaaataaacattaattttatttctttgtggttctagtttgggtgaaaaaaattgtctgcaggaagggagtcaactaaaggctttaagacctgtacaagtgttgggatacatccgggatcctctagatcgcccgc

SEQ ID NO: 292627 - DNA, 11017 bp, Homo sapiens
  misc_feature (4612)..(4612): n is a, c, g, or t
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccnagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtatacttcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagcctcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatatacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 292628 - DNA, 6780 bp, Homo sapiens
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcaggtatgtatttttctgtcctttaaaagttttttgaatgcttttttcagaggaaataaataattccatgattattttgtccttaagtccaacaacacttaaaaatctctaaaagtctaaagtcttttgtagccctaagtttctatgtttcagtgccttgaagaaactgtatgttcttttttaaaaagataactttaggctggtcttgaactgagctcaggtgatccacctgccctggcctcccaaagtgctgggattacaggtgtgagtcacagcgcccagcctcatgcagtatttttctttctgtgactggcttatttcacttaatgtaatgtcctcaaggttcatccatggtgtagcatatgagaagatttccttttttatgagcaaataatattctagtacatgtatagaccacattttctttatggacatttaggttgtttttgtctgttggcatcactgaacatgggagtgcaaatatctctttgagatcctgatttcagttcttgtggataaatacccagaagtggggttgctagatcatatggtagttctacttttaattttttgaggaccctccatactgtttccaatagcgggtacaccattttacataaccaccaacaatgtacagggttccagtttttttcacatcttcttcaatacttgttatcttttattttattaataatgtccttctgaacaggtagaaggtggtttcttatggttgttttgatttgcatttcccggataattattgagttgagcatctttcatagctgttagccatttgtatatcttctttggagacatgtctattcaggtcctgtgcccaattttttaattaggttattttcttttttgctattgagttttgagaattatttatatagtttggattttaggaccttatcagaaatatgatttacacattttctcccattccataggttgccttttcactctgctgtttcctttggcgtacagaagttttttagttcaatgtagtcccatttgtctaattttgcttttgttgcctatacttttggtgtcatatctaagaaactgttgccaaaaacaaacttaaagctgtttactatttttaagcatacaatttagtggcattatttacatttacattgttgtgcagccatcagcactatttctaaagctattttatcactgcaaacagaaaacctgtacccattatgcagtaattcctcattctcccctccctgcaaccactgataatctctaatctgctttctgtttctcatccaagtattaatcaggaccagacttgcttagtttgagatcaaattaggctcattgagagcggtaaggatgtagacaactttctgtctctatgactctgtctaatctagatattcacataagtggaatcatatgctatttctcatagttgtttgttcctaggtgacagataatctaaagtgtgagttcagagatacacctaatttcataaactacacaaaactgtactcgtgactttttctaatttttaaaataattaaaaaatgttgtgacagggtcttactctgttgctcaggctagagtgtagtagcgtgatcacagctcaccacaaccttgaactcttgggctcaaatgattctatcacctcagcatctcgagtagctgggactacagtcatgggacaccatgactggctaattttaaaaacattttttagtagagatgttttccaggctggtctcaaactcctgggctcaagcaatcctcgcacctcagcatgagccactgtgtctggccctagctttttctaatttaggggaaaaacaaccttgtaatgactgttaaagtcccagttggttttggaaaacaaagagttgattctaaaattgtcatgtacacaagaacaaaggctcaagaatggtaaagacagttttaaaaaacaccaactttgcagagggactgtgctagtagactaattttcgagctagagtaactaaagcagcatggtattggtgtagggttagatgaattgactcactggaactgaatatagagtttaggaagagacatttaggaatctgttatatggcagaggtagctttagaaattagcgggcaaagatagaactaacttcattagattgagctgagatttgaaaaacataatatttgatccttgtgttaccatatccgctaacttcctgatggattgaagactacatgtataaaacaaatctttacaacttttagaagaaatgtagaaaaatatctttgtaatgtgaaggcctcaggtaagacatttctattaagacgtagaaaacacagactttaaaagataagattgataagtttgatggtagtaaaattaaatacttctgttaacaaatcctccataaagaaaataaaaggcaagttactgatcgggagattttatgtgtaatatctagacaataaaaatatatagagaactcttgctgataagtcaggaaaacataaacacctagtagaaaaaatgaacaag

SEQ ID NO: 292629 - DNA, 11468 bp, Homo sapiens
  misc_feature (4612)..(4612): n is a, c, g, or t
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccnagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtatacttcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagcctcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatatacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatcaaaaaaaaaaaaaaaaaaaaaaaaaaaaaaaaaaaaaaaaaaaaaaaaaaaaaaagaaaaaaaaaaaaaaaaaagggggggggaaaaaaaaaacaggggagaatataacatttataaaagcaaaagataaaatgaagagagagccagcgtctatcaaaaaaacagaccgatcgaagaaagaaacagaacaaagaggttaaaatctgaggacgagaaccaatttgaccggggattaaaaaagaggacaccaccgcacaagaattcccgcaggggaaataaactaggagttgtactacgaaccaccctaataacgcagcaagacgtgccgacattaaacaataagcggcgaaatctacagggagaagaataacaggtaccgaggatacacgatagcagcgagaggagaagagtcaacacgacaacgtagaggcagaacacacggcacagagaac

SEQ ID NO: 292630 - DNA, 10580 bp, Homo sapiens
  misc_feature (4612)..(4612): n is a, c, g, or t
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccnagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtatacttcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagcctcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatatacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttcttttttaaatcaattaaaggagccttagctttttaatgggaaaaaatggggaacattttcctctaacctaattgttaaaagggaaattccccggggtggaaccctccatt

SEQ ID NO: 292631 - DNA, 10360 bp, Homo sapiens
  misc_feature (4612)..(4612): n is a, c, g, or t
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaagcgttcaagagaataataaggcaaataaacttaaccaagtcccaattctaaggactcgatttcagaaaccaaagccaaatataggaagaggaactggaaggagagaaatttcctcaaaggaagaggtactagagaagattcttgtctctggggaaatggcggcagcattgagagaaactgtaagactagacacctcaccaaaggagatggtaccagcagagattaatactaaagaaatgcagtcagatttaaaagaaactggaagaagagccatttctcccagggagaagattctagatgtgattgatgacaccatagaaatggagacaggtctgaaagcaatgggaagagagatttgtctaagggagaagacgccagaggtgattgatgccactgaggaaatagacaaagatttggaagaagctggaagaagagaaatatccccacagaaaaatggcccagaggaggttaagcctctaggtgaagtggagacagatttgaaagcaactggaaatgagagttccccaagggagaagacaccagaggtgactgatgccactgaggaaatagacaaaaatttggaagaaactggaagaagaaaaatatccccaagggaaaatggcccagaggaggtcaagcctgtagatgaaatggagacagatttgaacgcaactggaagagagagttctccaagggagaagacaccagaggtgattgatgctactgaggaaatagatttggaagaaactgaaagagaagtatccccacaggaaaatggactagaggaggtcaagcctctaggtgaaatggagacggatttgaaagcaactggaagagacagtttcccaagggggaagacaccagaggtgattgatgccattgaggaaatagagatagatttggaagaaactgaaagagaaatatccccacaggaaaatggcctagaggaggttaagcctctaggtgaaatgcaaacagatttgaaagcaaccggaagggagatttccccaagggagaagacaccagaggtgattgatgccactgaggaaatagacaaagatctggaagaaactggaagaagagaaatatccccagaggaaaatggcccagaggaggtcaagcctgtagatgaaatggagacagacttgaaaacaactggaagagagggttcctcaagggagaagacacgagaggtgattgatgctgctgaggtaatagagacagatttggaagaaactgaaagagaaatatcgccacaggaaaatggcccagaggaggtcaagcctgtaggtaaaatggagacagatttgaaagaaattagagaagaaatttcccaaagggaaaaggtgctagcagagttcagtgctataagggaaaaggagattgatttgaaagaaactggaaaaagagacattcccatgatggagaaagtatcaggaaagatggctgttgttgaagaaatggaggcagatttgaaagaaactggaaaagaaaattttagagagagaggatctgaagagatctgtgttactgaggaaaaggtggcagaattgaaacaaactggaaaaacagacatttctccaagggaaaacgagctagaggagaccagtacctcaagacaaactgacacacatttaatgcagagcggtagcaatgacttcagtgctatgccttcactagatattcagaacattagcagtgaagtactgtcgatgatgcatacacctgtagaagaaaaaagaaattctgaaaaagaagtatcaagtcacttcagtcatttcaagatttcttcacagactcatgaatctgataaaacagaagtccaggggattcaatctccagatgttccagagcagttttcagatattaatttaagcaaatctcttcctcaagaacagaagccacttgaaattaaaccagcaccttttgtgaggagccgattcaaaagaccaaaaccaaacttagcaagagcagctttgaagagagagactacagaatcagaaaaatatatatatgagaagaaatcagaaaccnagaaaatggagactattgtgatgcaagaaaataatgaacaaactgatactctcccttctcaacatgatgaagcttccctaatgatatcaagagaaaaagacacattaggtcacaggaatgaggaggctgtgatattgccatgtacacagactgaaaggaacctttcaccttcaaattcttgtgaacctaaagaggagtctcagtcagcaccagtccagaaaaatgactcagttgtttctgtggggactaataatgtaaacactttccagcaagaaatgaaggaaagtgttatccaaactgctcgacaagtaaggggccgacttcagagaccgagaccaaatataagaaagacaggacagaggcaaatagtagacaaaggtgaagccaaaggcataattaaggaaggaagaacgatattaccaaaagatgaaactgaaaagaaagtcttaactgtgtcaaattctcaaattgaaactgaaattgaagttccatcgtccgcagttccagaacacagaatgtatgaaaatcaaagtcaggtggttcttgtagaaaaccttcatgttaacaaaacaaatgaaacaatcagacatgaaaataaaccgtatgttcctagttcagcacaaatgacaagaaggaaattccaaaaggctaagccaaatttgggaagagcacacagtaagaaagaggaaccagttttagaaaaagtcacaacagatcagagcaaggaaggcaagccagaagatcatttgctgcagaaaggagcttccaacacccagctccttctaaaagaaaaagctgagcttctgacatctctggaggtttcagcaagaaaagattgtgtaggttccaaagagtctgctttggcaaaaatagatgcggaattagaagaagttggaccatcaagaagggttggagaggaaactgtaggagataattcaccatcttcagttgttgaagagcaatatctcaataaactaacaagctgtccacaaccgttaaacgaaacaagttactctaaaattgccctggatgggaaaacaactatctcttctacatctgagtatgagagaaatcgtggtgaaaggagaagtcataaaaagttcaaaccaaatgtcaccagaggtcgtggatcaaaacgagttcggggtaagacctctaagaaggaacctagagcttccaaggccatgctggtgactcttcgggcttcccaggaagaagatgatgatgctgacgattttgagtctgactatgaggaagaaagctatcatcttgctcccgaagaagtaaacaaagctccagtatttgtacctgttggtctcagatctcctgaacctgtttctgctcagattgaggaaacaatggaagagcttgaaataactgtgaatgtcccagatgtaggatgcatagctgttgttgaacatgagctaccaaacacagatgtgactactgaagaaatgaaacaagaagaaaatttgagtgtaccgtttgaaatgaccacaagtgaacatatccaagatgaaccaggtaccaatgatggaagcaccgaagctgcaataactttacttacaatgggagatctagtattgcagtcagagatcagtagtgaacagggtgatgtaggagtatgtatacttcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagcctcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatatacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctattgaacttctaaactaggggaccggctcgatcgatt

SEQ ID NO: 292632 - DNA, 5110 bp, Homo sapiens
atattatttaatgggagggaggcatggtcagtgagtcaaaaccaacagtgatgatttatttatttgtagcatataacctgaacaaaagactaccttagtaagggattaatggctcagaggatattggaatctgctcctaggagataaacaccttaattaaaaatcttttttaagtgaacagatttccggattcattcttttttttaatgttgatatatttcctcacaaggtaccaatgatggaagcaccgaagctgcaataactttacttacaatgggagatctagtattgcagtcagagatcagtagtgaacagggtgatgtaggagtatgtatacttcctcatgttcattcaaaggataaaagccatattccttctagcctagataatgtaaatcacaaaattgttcatgaatgtcaggaactttcttcacctgtcattactacatctcctgcatcatttgaagaaaacaagattgtattggaggaacaaagttccagagaagaaataagtttaatggagaaagtaaaggagaatgctacaccaaccaggaatacaatttctaaagtgaccagtaatttgagaataagaagtaggcttgctaagcctaaaccaaatcttgagaagactttagggaccaacaggcttgatgattatcaggaagtttccagtttgtgtgtaaccaaaggggcagaaatggaaactcaaagagaaacagagaaaaatgcttccaaagcaacagaattggaaaataaaaaccttggaccagttacaacagcagagaataaggatcagagcaaattggcatgtgtacatggtatcaaagggaccagtatttcttcagaagtaaacctaactgaaagaaacgaaaatcaagaagagagctctcaggaggttcacatgttgtcagttgctccagttgcttcctctgagacagggccctgcacacttggtttggataggggtcttggtgaaaattctgttgaagagccccagataaaggactctaaaggagacagtgtgcttacacttcctgtgccagagtatacaccaacaagtattccagaagtccaacaagagaatataatcaatcctcaagacctaacagtgaatctagttgctaatgtacctcaagatggagaagatgaacaagcctttattttaactctggtggaaatcccagccaatgcagtagaagaatttactgatgccactgcacagttcatgccaaaccctttactgccagctcccatattggtcaaatcagtgaataccgaagaaaggggtgacatgagtatttgtttaccagcaacttcagttggtcaagatgccatgggtttatctatttctggaagagataattctaaaaagcctcctgataatttggatcttgtatctaggaagagatttcaatgcaggcttgataaaaatgaccacattcctcctgccaaaaaacgttcactcactttaagagatgactgtcaagaatataccactgaggtgcactcaaaggaattaacaaatgtttttgaggaaacaggggagtctcacaagggacaagatatttttcttacctcaggaagcacactgacaactccagaacctcaaagacagcaagttgaagcagcttttcagagtagaggatctagatctcctgatgcatgcatggacaagaatgtgcctcagttacctcaggatgaaatgattgtgtctgataaggaagaaagaactgatgctgctcctaagtctcagcaaatggatagcagaacatcgtcttctaaagcctcactatccagacctggcagaagacccctgggatttttatctttaatatgctcaaagaatagtttggagtctgatgaacctatgcaagtccatagtaagaaacgcctaaaacctcttatacctggattaagaaagaaattgaaaagatctaatccattcaatgaaagccaggaaaaaaatcgagagtcctctgatctgcttccatctccaagtgttattactactcaatctgagaatattagcagctcagcaactcaggtttcttgtgatcagcccttactgaaagaaggatataaaagtgcccaaaagcgggcccctcaaggggaggcaaccacagtctctgaatatttcttcaatgatatcttcattgaagtggatgaaacagaataaaacaatcttttctctttttcttttttaaattaggtctaggatttccagagtcaattacatcaacaaaacagtatttagagcaaaatatcactgtcttatttttctttaggttgattttgaatacttaatgagcttgatttgaagcttttataatcagtggaaaacatttctgaggttcctttcattctgactgattcagcattttgcaaatagcaagcaattaagactgctttctcagacagaaataacaactcttgtttacattttgactcttcctgtgctaagcacacatggacatttgggaatgttgtggatatatgtctctgtatgaattgcagtgcagacagatttgggggttaattgtatcatatttaacatttagcaacttcttttgtgaagattttttatttttagggggagatgatgaaggatgaaggctttttcatttgcttctaagtacagtcatgtatcacataatgaagtttaagtcaatgatggaccacatatattacagtggtcccatgcaattaaaatggagataaattcctatcaactagtgacattatagccatcataacacagtgcattgcttttttatgtttagatatgtttagatacacaaatacttactattgtgttacaactgcctacagtattcagcatagtaacacattgtagaggtttgtagccgaggagcaataggctataccacatagcctcagtctgtacggtgtgtagcagcctgtaccatctcagtgtttgtaagtacactctgcgttgtttcacacaagatcacctaacaaggcaattcttagaacatgtagttaagggacacgtgactatatgtgaaaacaaattgtcaaacttcactttagtatggcaaatgttaaagaacttttctattatcagctgtttgtctgactgaaaaatacatatttttctaattcatggtgatgtaacattagtcctaattgaaaaactagtatttaaacataattatttataaagatgacacatcaaagggcttatttatttttaaattttttatttaaaaggatattcagttttagctatttttacccctcagattgtagataaagaaggcattaaatttatgtttgtctcctttttctgtttaattttaaagatatttaaaatgatataactaaaaatgtttagctggtgtatatgttttgaatacctttttcccctcagtttagtatattgactttgtactgtaaatttttctgcttttcttggataatctcaggattttcatgaggatagggggaactcaactttatttatgagacaaaatttccatacaaagctcaatctcctttatatacccacagacataatattagtttttaaaaagccaatttcttcatagttttttcccattaaattctcaaggaacacttggatctttaagcacggaacataatcatgatgttaaaaacagagaaaataaggctttataaagttaatgattatcatcagtatgaatttaaggtttgttttaatttcaagatttgattttttatacgtgtaattctattatctacccaagcagatctgtagtggttccaattagacttctcaaacagcaaatttatcctgattttatttgaaaagcctcttggattgatagtatagtagctcaggcattggaaactttctgcaaactgttttgggtttgcaggccagatggtctctgtggcagctactcagctctgcaatttcagtgtgaaagaagccatagacagtacttgaatgaaggactgtggctggattggccttttagtttgaccccctacattaggccccaaattttcttaccctgaggtgctgatatctgtatggatgagttatttgtcactaaagttatgagttgtgcctaaaagttaaaactgttgactgtattatgtaatgatcagtatttcagttgggaagatattttagagtctagataattatgtttgtatattgaaaaaatggtggccagtttttaagttccttaatagaagagaattatgtctcagcacatataacagtaatgctaatttattgaaactactgctgttagagcacttcttattcattgtcttttagtgaaatttatggcgtaacactttgtcagagaggaggctatataattcggagcggaaattgtctataagtaggcatttatttcatgattgatatgtcacagaaatcatggtagtaaatcacattgctatttgaataccctgtttttgtaagtttttaaaactcatattctgaaaagatttcattctcttagtgttagcttgggagttagattgccatgattaaactattatttatccttgtgtaatattagtttttaactttaacatctgtttctttttaatctataatgagctagttttatggaaaatggaatttcttactatataaagaatacagagactcattgtattagagaatcaagtcagccagctaaagtatcctactgttaaatccttaaacctaattttggaaaagagaaagttaatcaatgtatttaccttacatgttggaaagaactatgttaggtctgattcatgtgaagaagatgttgcaaaggatttatttcacaaattttaaaggagatatgagtaaaagtttttatcttttcttgactttttctcctgaacacttatgtcttagcaagtggtcaacatgaggatttgaacgcctaattgttggtaaatggttgaggcatgacaaaaatattaatatccactgtttaccatcatgttatttgaaacaaaagtgaccatgtatactatcttgcttgaagaagtctttgacagaaaaagcaatatcatgtcatttataaattttcttgttctaaagaaagcagttatatatatatataaattatgtaaataaaagttattttatatca

SEQ ID NO: 292633 - DNA, 3025 bp, Homo sapiens
ggtgtgtggcagggtcatgaaaaagcggcggcggcgggagagaggaggaggcggcggcggggcagtgaaactacggtagctgccccctgagctggtggtgtggctttgtggggagggcgtagttcctaatcccctttccgggcagccgccggggctcggggctgtgagcggccgtgaggctgcctccccgggccccctgcctccgccatgttccgcagggcacgccttagcgtgaagccgaatgtcaggcctggtgtaggcgccaggggctccacagcttccaatccccagcgtggacgggagtctcccaggccgccggagcctgccacggactctgcttccaagcccgcggagcccacagatgtgcccacagtcgatttcggtggagcggagccccaagaaaaggctcctaggagcagtactgaaaagactggtggtgacaatgatgttgaagaatccagtagatcttcctctactgtttcacagagaagaaagcgaatatcaagtacttctagcctggttaagtctagtgtcagtgttccttcagaatctcatcccttatctacaattaatcaagaggctccacagccaactgccacttcaacaaaagagaaacagccatgctcagacagataccgaatatacaaagcccagaaactgagggaaatgttaaaagaagaattgagaaaagagaagaaacaatggaaaaacaaatatgctataaatgaaagtcagaggccaccagatcgttcaaaaatgactatgagagacttcatatattatctaccagataataatccaatgacttcttcactggaacaagaaaagaaaactgaaaagccatcgactccagtccagacaagagagcaagaaggtaagagtactcctaatgctgaagataatgaaatggaagaagagacagatgatgggccattactggttcctcgagtaaaagtggcagaagatggttccattattttggatgaagaaagtttaactgtagaagttttaagaacaaaaggcccttgtgttgttgaagaaaatgaccccatatttgagcgcggttctacaactacatactccagctttaggaaaaactattactctaaaccatggtcaaataaagaaacagatatgttttttttagccatcagcatggtaggaactgacttttctatgatcggacaactttttcctcacagagcaaggatagaaattaagaataaatttaaacgggaagagaaaacaaatggatggagaatagacaaagcattccaggaaaagcgcccttttgacttcgatttttttgctcatttgcttcagaaagttcttgctgaagaagagaaaagaaaacaaaaatctgttaaaaatcacagtttaaaggagaagaaatccaccaaaccacggaaaaatgtaaaagtgaaaaaagttgcctgtgaaggagtgaataatgatccagatgagtctatgagttctagaatttcagacacggaaagatctcagaaggatgctcagacagttgaagaagagtctctgaccttatcaagggaggatgcagagcaggttgcattagaagtagacctaaatcaaaagaaaagaaggaggaagaagcaagatggagctaatgaactgggagtaaacaatcttttagaaaatgccactgttcaggcgggtccttctaaaggagaaaaacacaagaataaatgtcaggctataaggcctgagctaaaggaaggtgaatgcagtaaggagcagatgctttcctgcacacaaaacatagatggcattgtgggttttgcctccactgaaaaagttgagaaaagaactgaccccatcctttcattaagtaatcaacaagatgccacatcagtagcaactgagtcttcagaatcaagcacttcagatttgccttcattcgaagttggaattagagcattgtgtgaggtgaataatgctgagggtagttgtatagaagaaagaaatgttgacctaaaaaataattcactggaaattgatcaaacagaaaatgttaaaccaatgttgagaggtcgcttccaaagacctaaacccaatttgtcaagggctgggaagaaatcagttctttcacaaggcaaaacagagtcagagagcaagaattcacattcaaaaacttcagttgaaaagaaccacgtggaaaaagataaaatgaatacattggacattttgagaatggagactacagagagagagaatccagaagctgaaactgtatctgttttgggtgaaaaaaattgtctgcaggaagggagtcaactaaaggctttaagacctgtacaagtgaggggccgattgcaaaagccaaagccaaatgcaggtaaagctgctgaaagaaaagaaattctcatatcacaggaagaaattggggccaatgtagagaagaatgaaaatgaatcctgtgctgatagagatactcctcaacacatggaagatcaatcgcgtaaagattttgaagaggaagatgtcatattacagcctgagaaaaatgattcttttcaaaatgtgcagccagatgagcccaaggttcttaatgaatgtctaaggtaagcatcattttgttgatatataatctttggattttgtaaaaagttttagaactcaatcagttttttaaagcagaagcaatttagatggatttgttgtctgcgtgtctagttatgtagtgtttaaaaatataacttcacctttcaagaaagtttatgttgtagcctttatgtgaatttctcagatggtttgaagaaagctactcatcgtaaattagtacttgagttaacatgaatagccttatcactttattttattttattttactttttattttttgagacggagtttcactcttcttgcctgggctggagtataatctcagctcactgcaaccactgcttcccaggagaattgcttgaaccaggaggtggaggctgcggtgagctgagatcgtaccactgcactccagcctgggcaacagagtgagactgcatctcaaaaa

SEQ ID NO: 292634 - DNA, 93 bp, Homo sapiens
cggccagttctgttgttttaatttccatttgtttattacaaagtttgaactgtttattgtaagtagataaattgtagcaaattaaattcacag

SEQ ID NO: 292635 - DNA, 284 bp, Homo sapiens
cactgcacagttcatgccaaaccctttactgccagctcccatattggtcaaatcagtgaataccgaagaaaggggtgacatgaggtaacgaatgagtgaaactgtttttgctaggaggaaaagtgatttatgaactaagtagcattgattgaacaaaccattcaccaatgttagttgttattgttgtggagatcttatttatcatttatgtggtaagttagagaagaaatgtaatgtggtagattttatatctgataaagatgccacttaaatgtttcatgtat

SEQ ID NO: 292636 - DNA, 563 bp, Homo sapiens
gctggtctcgaactcctgacctcaagtgatctacctgcctcaactttccatagtgttgggattataggcgtaagcctccatgcctggcccagccactcttattcttgtaccacctcttcctcacatccttgaggagataaagaatgtgtcatggctctcctttctgctcttgatcatgataacgttctaaagggtgtggaataaattacagtacagaactggtgtgtgctatgtgacatgagaggtactgagattagtttatggaagtaacagtgttatagttcctttataaattatttttctctaacttcatatatgacatagttgctaagtcattttgggaagtgttcgattggtgtatggcatcaccttgtatttgggcaaatacaatatatacaaaaaaatattacacatacataacttttttttttagacagtgtcttgctgtgttatccaagttggagtgcaatgtcgtgatcacagttcactgtaaccttaaactcttgggcttaaactatcttcccgcctcaacctccactacaagcagtaattaaaaaaaaaaa

SEQ ID NO: 292637 - DNA, 456 bp, Homo sapiens
cgtgctgtctaagctaatgtggagttgtgttttcgggtcctcagtctgctacgccatcctcgtgggtgtgaagtgacatctcattatgattatcatgtcttcttaaagaagcaaacacaaccaaattcagaagaatttataaggctggtgtctgattgattgaaaaggccccaggaagtggattttgccttcagagttcaactcctcctctggtgcagtcccaaaacactaggattctgctgtctacccaagagaacccaggaactctgagcaaccacactggcttcagtcagcttgcaaaactggcttttaggcttgttacctgatatacattctagaaatgaaccttctttggtacaaagatctccactgaaatttcctaaaagacatcattcccctgtaccccaagggaacctattcctagataagaatgcaaactcaccgtgaaggggtcgt

SEQ ID NO: 292638 - DNA, 355 bp, Homo sapiens
cgtgctgtctaagctaatgtggagttgtgttttcgggtcctcagtctgctacggtaaggcctgcatacagttgatacttcatcctcaacaaacttgtgatgttgaagtttttcccttaactattaagtaagggagcctacagttgaacctgtttcttctggttgtaaatctcaggtgtttctacagaaggtattctctctctttccctctctctctctctctctcactccctctccctctctctccctctctccccctttccctctccctccctccccctccccctccctctctctccctccgcctccctccctctccccctctccctctctctcccatctctccatctttccct

SEQ ID NO: 292639 - DNA, 1395 bp, Homo sapiens
ggccagagccggggagctgggaggggtctaccggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccggaccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaagacagttcccagcgcgctgctcgtccagctgattcaggaacgcctggctgaagaggattgcatcaagcagggctggattctggatggcatccctgagacgcgtgagcaggctctgaggatccagaccctggggatcacacccagacacgtcattgtgctgagtgctccagacacggtcctgatcgagagaaacttggggaagagaatcgaccctcaaactggagagatttatcacaccacctttgactggccacccgaatctgaaatccagaaccgtctcatggtgccagaggacatctcagagctggagacggctcagaaactgctggagtatcataggaacatcgtcagggtcattccctcctaccccaaaatcctcaaagtcatcagtgctgaccagccatgtgtggacgtcttctaccaggctctgacctatgtccaaagcaaccatcgtactaatgccccgttcaccccgagggtgctgctgctcgggcctgtgggcagtgggaa

SEQ ID NO: 292640 - DNA, 782 bp, Homo sapiens
ggccagagccggggagctgggaggggtctaccggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccggaccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcaggtgaccggacacccctgcccgtcgcgacgctggcggcggctcgggagcctccactgcgacgtcgggtgcgcggccgggacccgcagctggggccgagtcgcgcgcccacgaagcagcccaactcgggatgtacgattcgtgtgtc

SEQ ID NO: 292641 - DNA, 818 bp, Homo sapiens
ggccagagccggggagctgggaggggtctaccggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccggaccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgctgctttgaaggagctaccagtgcaccagtgaaattagtgcttggtacagctgaggacagagcccagagatgccctgtgtggaggttcagaaggcc

SEQ ID NO: 292642 - DNA, 1100 bp, Homo sapiens
ggccagagccggggagctgggaggggtctaccggggctcgactctaggagttgggctgaggatttccacccgatcctcgaacctccggcccatctcatggacgcccctcccccttcaaacaccctcccccacatttattcccgcgtctgttttaaagatgggtaaactgaggcacagggagccggaccggggagcactgacagaaccagaagcaggttctgcctcccgtcccctcggagggccgacttgccccttctgggtttcgtcgggggtctcagatacgaggaggcccagctggaagccacctgagggtgtcccccgctaagatgcgcaaatgggaaaagcgaggccggggttggggaaagaacttgcccgagccgcagagcgcgtcagccggggaggtcggggcgggggcgacccgcgcgaccgaggatcgggtatctgggcccggcgcggagcctgcagggcggggccgcggcgcgtgctgatgacgcagtcggcgcggcggccctagcgacgcggttactagggagcggcgagccgagacggctacatggacgccactatcgccccgcaccgtatcccccccgagatgccccagtacggggaggagaaccacatcttcgagttgatgcagaacatgctggagcaactcctgatccaccagcccgaagatcccatccccttcatgatccagcacttgcatagagacaacgacaatgtgcccaggattgtaatattaggtccacccgcctcagggaaaacaacaatagcaatgtggctctgcaaacatctgaacagcagtctcctcaccctggagaacctgatcttaaatgagttttcctatacggccaccgaagccagaaggctttatctgcaaaggaaggcatttcccagtggtttctgaaatacttcctaactgcctttttgccaagcactattctgcagtgctgtgggagagtcaaagatgagtttcttctccttaccccagaagcttccagccagtgaggagactgatggtcccataaaactaagcacaagccagggtatgggagccagggaaccttcaataaagcaattaatcggtggcttgtttgact

SEQ ID NO: 292643 - DNA, 396 bp, Homo sapiens
ttttcttttcctctccagaggggccgattagggagaggcgtgtctctctgtgacccgagtttggccaacaggcattttcagttccacccccaacccccagccccgctgacccgaggcggagagcaggcgcggaggtcgctgtcgcgtacccagcggagccgggcgggcggggagcaggggcgctgattcgctggagaagggatcttctcgaggtttgactttactggcttcttagctcttgaatcggtttttctgaaggagattgtgaagaagccaaggtgctggctgaagattacacctgtctgctcggttacccatttactctggagaattaatgcttattgtactttttaaaataaaacttatttttgtgtttccggaaagtttgctctttag

SEQ ID NO: 292644 - DNA, 359 bp, Homo sapiens
ggacacacagtgtccacagatttagttaatacaagcatgtcttgtgtcaggggccacttacggttgtgatagttttagagaagttccctccccacaccctgcccccccaccaagaacataggtaaaaataatctaatttggaaattatttaatgggaggaagtaatagtaatattatcatcatcccactgtatttcgtgaaaagggctaatctcaagtgcctcctttgtgcaaatgagccagactcgaagggtacaatcagaaaacagctttaatctttcctagcttggcccctgagattggctatgtgagaacagtctttctcaggctttttggatgatgtaagaaattaaagctttt

SEQ ID NO: 292645 - DNA, 3261 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttag

SEQ ID NO: 292646 - DNA, 3499 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292647 - DNA, 3074 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacata

SEQ ID NO: 292648 - DNA, 3445 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaattggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292649 - DNA, 3060 bp, Homo sapiens
ttccagatgctggcggatccccgctccttcgactccaacgccttcacgcttctcctccgggcggcattccagagtctgctggacgcccaggcggacgaggccgtgttaggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292650 - DNA, 3034 bp, Homo sapiens
tcgatcggaacgcccgccgaggctcggggctcgggccgggctccgcgcggagttgcagcggtggccggatgccaagtgtaagtgattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292651 - DNA, 3417 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292652 - DNA, 3827 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattcctgtaagtaccgagctttagctctcttttgtatcatgcgtatttcacagttcgacctggaatttgaaaactgttaatgattcctgcaatctgtggaaatgttggtacaaagtggtgaaggcattttcttctcttgcatctaatgactttttgttaatatgtattgattgtattacaagcatgcaatatatgtgttctcaggatatgaattagcttatttagttggaaatgcctttcaccatcttgttttctactagttctgggtttctaacaccaatgatttatccactcatttctaaacataaaaaaacttcacatgttctacttctagtctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292653 - DNA, 3520 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacaggtaaaatctttaggcaatttattttatgctaatgttttattagattgtttcactaataaattttctctttattagattggatcggaaagtaaacaaagacaaagagaaatctaaggaggaggtgaatgataaaagatacttacgatgcccagcagcaatgactgtgatgcacttaagaaagtttctcagaactttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292654 - DNA, 3150 bp, Homo sapiens
gacttcatgacaggcaggaataaatatttaaaagggcttccattcctctttattccctattcatattagctagtttagtaacttgaaaggcacacttcttttgacagagcaaatgtgaagaatttattagtgaatataaaatatttttctactgatttaaaaagtgctatatacagagaacttttattctcatagtttttatcttatcaataatagttatagacagcatcacaatcaagtaaaatattatagcacaaaagaagactatagaaacttatgaacatttttagttcttgccatctgaattcatagttttctattttaattatttttcaggtcagataaaactctccaagatattgtatacaaattagttccagggcttttcaaaagtgagtaacttgcttagaaaatgaatttaaagagattattcattagttctttgtgttatgccaaatgtttacatcttttttccccattcagatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292655 - DNA, 2684 bp, Homo sapiens
atcctcttatatataaaatttattaggcatctgatttttaaaaattacatttcactatatcgttatagctgccaatggctctaatgaagatagaggagaggttgcagatgaagataagagaattataactgatgatgagataataagcttatccattgaattctttgaccagaacagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctacttgtaaaagaatgaagatcagtcaccagagagatggactgacaaatgctggagaactggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292656 - DNA, 3520 bp, Homo sapiens
cctcctcccctccccccgctcgcacgacacacacggcgccccccgcccgcccgcctcccccacagcaactatgaaataatcgtagtatgagaggcagagatcggggcgagacaatggggatgtgggcgcgggagccccgttccggcttagcagcacctcccagccccgcagaataaaaccgatcgcgccccctccgcgcgcgccctcccccgagtgcggagcgggaggaggcggcggcggccgaggaggaggaggaggaggccccggaggaggaggcgttggaggtcgaggcggaggcggaggaggaggaggccgaggcgccggaggaggccgaggcgccggagcaggaggaggccggccggaggcggcatgagacgagcgtggcggccgcggctgctcggggccgcgctggttgcccattgacagcggcgtctgcagctcgcttcaagatggccgcttggctcgcattcattttctgctgaacgacttttaactttcattgtcttttccgcccgcttcgatcgcctcgcgccggctgctctttccgggattttttatcaagcagaaatgcatcgaacaacgagaatcaagatcactgagctaaatccccacctgatgtgtgtgctttgtggagggtacttcattgatgccacaaccataatagaatgtctacattccttctgtaaaacgtgtattgttcgttacctggagaccagcaagtattgtcctatttgtgatgtccaagttcacaagaccagaccactactgaatataaggtcagataaaactctccaagatattgtatacaaattagttccagggcttttcaaaaatgaaatgaagagaagaagggatttttatgcagctcatccttctgctgatgctgccaatggctctaatgaagatagaggagaggttgcagatgaagataagagaattataactgatgatgagataataagcttatccattgaattctttgaccagaacaggtaaaatctttaggcaatttattttatgctaatgttttattagattgtttcactaataaattttctctttattagattggatcggaaagtaaacaaagacaaagagaaatctaaggaggaggtgaatgataaaagatacttacgatgcccagcagcaatgactgtgatgcacttaagaaagtttctcagaagtaaaatggacatacctaatactttccagattgatgtcatgtatgaggaggaacctttaaaggattattatacactaatggatattgcctacatttatacctggagaaggaatggtccacttccattgaaatacagagttcgacctactttggaaagtgactctgggagtgacaaggccaacagcccagcaggaggtattccctccacctcttcttgtttgcctagccccagtactccagtgcagtctcctcatccacagtttcctcacatttccagtactatgaatggaaccagcaacagccccagcggtaaccaccaatcttcttttgccaatagacctcgaaaatcatcagtaaatgggtcatcagcaacttcttctggttgatacctgagactgttaaggaaaaaaattttaaacccctgatttatatagatatcttcatgccattacagctttctagatgctaatacatgtgactatcgtccaatttgctttcttttgtagtgacattaaatttggctataaaagatggactacatgtgatactcctatggacgttaattgaaaagaaagattgttgttataaagaattggtttcttggaaagcaggcaagactttttctctgtgttaggaaagatgggaaatggtttctgtaaccattgtttggatttggaagtactctgcagtggacataagcattgggccatagtttgttaatctcaactaacgcctacattacattctccttgatcgttcttgttattacgctgttttgtgaacctgtagaaaacaagtgctttttatcttgaaattcaaccaacggaaagaatatgcatagaataatgcattctatgtagccatgtcactgtgaataacgatttcttgcatatttagccattttgattcctgtttgatttatacttctctgttgctacgcaaaaccgatcaaagaaaagtgaacttcagttttacaatctgtatgcctaaaagcgggtactaccgtttattttactgacttgtttaaatgattcgcttttgtaagaatcagatggcattatgcttgttgtacaatgccatattggtatatgacataacaggaaacagtattgtatgatatatttataaatgctataaagaaatattgtgtttcatgcattcagaaatgattgttaaaattctcccaactggttcgacctttgcagatacccataacctatgttgagccttgcttaccagcaaagaatatttttaatgtggatatctaattctaaagtctgttccattagaagcaattggcacatctttctatactttatatacttttctccagtaatacatgtttactttaaaaattgttgcagtgaagaaaaacctttaactgagaaatatggaaaccgtcttaattttccattggctatgatggaattaatattgtattttaaaaatgcatattgatcactataattctaaaacaattttttaaataaaccagcaggttgctaaaagaaggcattttatctaaagttattttaataggtggtatagcagtaattttaaatttaagagttgcttttacagttaacaatggaatatgccttctctgctatgtctgaaaatagaagctatttattatgagcttctacaggtatttttaaatagagcaagcatgttgaatttaaaatatgaataaccccacccaacaattttcagtttattttttgctttggtcgaacttggtgtgtgttcatcacccatcagttatttgtgagggtgtttattctatatgaatattgtttcatgtttgtatgggaaaattgtagctaaacatttcattgtccccagtctgcaaaagaagcacaattctattgctttgtcttgcttatagtcattaaatcattacttttacatatattgctgttacttctgctttctttaaaaatatagtaaaggatgttttatgaagtcacaagatacatatatttttattttgacctaaatttgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgccaaaaaaaagaa

SEQ ID NO: 292657 - DNA, 911 bp, Homo sapiens
cttgaaatctgagctgttttaatatttctaaataatagctttcctattataccaaaagaatggaagttttagtttgtacaggaagaaaaataattggaactgaattgagcagtaggcgtgagaatgtggcaggaggtaaatggatgctacaagcaaaatgactttccctcccattgcttgagttcctagcaaaataaagtgtgcaaaatgatgccacttgatttttcaggttctcaaattaaggtacatttctcaatggattgatacccagccttctaggggaaaatgttttggttttactaacttgacattaagcaaggtggttttagtaaataaaatagctttgaatgataatattttgttttactacacaatatatttttagtcaatcagaacaagaaacattttagtggtaaagttattgcaactaattttttaatacatgcttactcaaagaatagactattgtgatttctaatcacagtgattcttttctcccaaattaagatttggtttgatttacaggtaaacagtgttgacctcagagctgctagtcatgagcaggcagcagctgcattgaaaaatgctggccaggctgtcacaattgttgcacaatatcgacctgaaggtaataacattcttattgtctatagttattgcttattttagtttttaaaattcttcctctttaatatttaataatgtttaacttccaagctaaacttccttttttgtgctttttttctgatttgctaatccagtatttgtttagtctgaacctagttctttttccagatcaaaagttgtttgtttttttggttttttttggtttttgttttttgtttgttgagacggggttccactcttactgcccaggctggagtgcagtggtgcgaactcagctcaccgca

SEQ ID NO: 292658 - DNA, 3046 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292659 - DNA, 2980 bp, Homo sapiens
gttggaaacggcactgctgagtgaggttgaggggtgtctcggtatgtgcgccttggatctggtgtaggcgaggtcacgcctctcttcagacagcccgagccttcccggcctggcgcgtttagttcggaactgcgggacgccggtgggctagggcaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctctagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292660 - DNA, 1061 bp, Homo sapiens
gtttctgagctgcttttcttttcccctgtaggttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtaagtataagaaatctattgtcttttaaatcattttgtagtctgtttatttttctgatagatactggaatttctccataccaaaaaggtctaaatgatgtttaaattagcaaatactagccttgctgtatcaaatcctaaaaaatgattcttggtaattctttatttgtcatttctcttttctctgctagctcctcctcccttttccttttattcctttgttgttgttgagggcttgtatgcacagagtgtttcatcataatccttaggtttataaaacaatgtcatcatttgtttatgcatgacccttttttattttacttcacttaatagtataatgaaacctagtaattacccagcccaagaattagaacatcaaccattttgtgtttcttattcctttgcttcttaaaaattgtttaatcaggccgggtgtggtggctcacacctgtctgtaatcttagcactttgggaggctgaggtaggtagattgcttgagcccaggagtttaagaccagcctgggcagcatggcaaaaccctgtctct

SEQ ID NO: 292661 - DNA, 555 bp, Homo sapiens
attacatattacttttgttatacatatagctcatgctcggagagaagtattctttcatgtaggttcgccctaccccacccccccattttagtttcatagttatggagaatttcaaggtgcttattagtactccagaaaacatttttaaatatgtattttataaatgaatgttagtcagtgatgctatctttaagtctaaaaattcccacgatggaaataactattaaatttcaaataccacacactgaaatattttcagacacttgtttttaaatattagttggtatagaaacagtgcatttccagcactttggaaggctgaggtgggtggatcacttgaggtcaagagttcaagacaggcctggccaacatggtgaaatcccatctctactgaaaatacaaaaaaattaaccaggcatgatgacacatgcctgcagtcccagctactcaggaggctgagacaggagaatcacttgagcctgggaggcggaagttgcagtgagcctagattacgccactgcactccagcctgggcgacagcaataactccatttc

SEQ ID NO: 292662 - DNA, 411 bp, Homo sapiens
attacatattacttttgttatacatatagctcatgctcggagagaagtattctttcatgtaggttcgccctaccccacccccccattttagtttcatagttatggagaatttcaaggtgcttattagtactccagaaaacatttttaaatatgtattttataaatgaatgttagtcagtgatgctatctttaagtctaaaaattcccacgatggaaataactattaaatttcaaataccacacactgaaatattttcagacacttgtttttaaatattagttggtatagaaacagtgcatttccagcactttggaaggctgaggtgggtggatcacttgaggttgaattggttcagacggctttgaaagtgactcaggactcaaatttaatagaagaagttggcccgggaa

SEQ ID NO: 292663 - DNA, 611 bp, Homo sapiens
gggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagaggtgagataaaaaatgtgttctgaagctgttttttggtgatcaatttatttatgttactatgtttcttta

SEQ ID NO: 292664 - DNA, 643 bp, Homo sapiens
  misc_feature (613)..(613): n is a, c, g, or t
  misc_feature (621)..(621): n is a, c, g, or t
gtccagttttttggctgatgagtaaatcttctctaccaaattctgatatataaaggagtgcatataaattacacattaatcactcataaatggaatactgattggcttgtttcgtgtttgaagtatttttcactttgtttattttgaagcttcttctcagcctgttgataaccatgttagcccatcttccttcttgggccagacaccagcatctccagccagatactccccagtttctaaagcagtacttggagatgatgaaattacaagaaggaagttaacatttatccttcttacataaaatcaactattaaattgaattttaatcagccatgtaagatagccacaatttttaggactaaaaaattttattgacagttagtgagcttaaaggttaatttttttccataggaggattcattgaagagcctgaaatatacatgttttatttttacaaataaattaccactccttttttaaaattaatactgcttttctttgaggcttggtaaattgtccttaggaattagcttagtaaaactaagttaagaaaattcttatgcatattttaaagtaacattttatatgttccttatctaatatataccatagntttaacangaaggtttactctgttgcccaa

SEQ ID NO: 292665 - DNA, 3296 bp, Homo sapiens
  misc_feature (3)..(3): n is a, c, g, or t
  misc_feature (5)..(5): n is a, c, g, or t
ggnangagggaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292666 - DNA, 2027 bp, Homo sapiens
  misc_feature (3)..(3): n is a, c, g, or t
  misc_feature (5)..(5): n is a, c, g, or t
ggnangagggaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcgggtaaacagtgttgacctcgagagctggaagacacactggacagcac

SEQ ID NO: 292667 - DNA, 2027 bp, Homo sapiens
  misc_feature (3)..(3): n is a, c, g, or t
  misc_feature (5)..(5): n is a, c, g, or t
ggnangagggaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactatggagtttcgctcttgttgcccaggctggagtgcagtggcgtgatctcggatcaccacaacctctgcctcccagattcaagccattctcttgcctcagtagctgggattacaggcatgcgccaccacgccctgctaattttgtatttttagtagagacggggtttctccatgtttggtcaggctggtctcgaactcccgacctcagatgatccacccacttcggcctcccaaagcgctgggattataggcatgagccaccgagcccagctgattatgttactttttcccccatctgttattgaactaataaagcattatgaaaa

SEQ ID NO: 292668 - DNA, 1950 bp, Homo sapiens
  misc_feature (3)..(3): n is a, c, g, or t
  misc_feature (5)..(5): n is a, c, g, or t
ggnangagggaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaaggagaagatggagaaggaatatttatttcctttatcttagccggaggacctgctgatctaagtggagagctcagaaaaggagatcgtattatatcggtaagacacgttagtcaagatcacgtttttgt

SEQ ID NO: 292669 - DNA, 2104 bp, Homo sapiens
  misc_feature (3)..(3): n is a, c, g, or t
  misc_feature (5)..(5): n is a, c, g, or t
ggnangagggaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtaagtataagaaatctattgtcttttaaatcattttgtagtctgtttatttttctgatagatactggaatttctccataccaaaaaggtctaaatgatgtttaaattagcaaatactagccttgctgtatcaaatcctaaaaaatgattcttggtaattctttatttgtcatttctcttttctctgctagctcctcctcccttttccttttattcctttgttgttgttgagggcttgtatgcacagagtgtttcatcataatccttaggtttataaaacaatgtcatcatttgtttatgcatgacccttttttattttacttcacttaatagtataatgaaacctagtaattacccagcccaagaattagaacatcaaccattttgtgtttcttattcctttgcttcttaaaaattgtttaatcaggccgggtgtggtggctcacacctgtctgtaatcttagcactttgggaggctgaggtaggtagattgcttgagcccaggagtttaagaccagcctgggcagcatggcaaaaccctgtctct

SEQ ID NO: 292670 - DNA, 3199 bp, Homo sapiens
  misc_feature (3)..(3): n is a, c, g, or t
  misc_feature (5)..(5): n is a, c, g, or t
ggnangagggaggttccgggggtggggcgtgcggcagcaactgggcgagcgggccggggggccgcggcgagcgaggaggcggcgcggccgagaaggaggacgaggccgcgggggtgcggcggcccaggggagctcctcccccgtcccttcaccccctccgctcggctccgcgggccccgggcggggcgggggtacgtggagcggggccgggctggggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctccccccagtactggtcaacacagatagcttggaaacacccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292671 - DNA, 3247 bp, Homo sapiens
ctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttagtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292672 - DNA, 2942 bp, Homo sapiens
ctggctcaggggccaagggtcggagcgcttcacccgcccgtacccagtagcaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292673 - DNA, 2845 bp, Homo sapiens
ctggctcaggggccaagggtcggagcgcttcacccgcccgtacccagtagcaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggcaaatcctccccccagtactggtcaacacagatagcttggaaacacccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292674 - DNA, 3082 bp, Homo sapiens
gggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292675 - DNA, 3133 bp, Homo sapiens
ctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292676 - DNA, 2876 bp, Homo sapiens
cgctctttggatccccctcatgtaggccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccaaaatgtatagatcgttcaaagccgtctgaaccaattcaacctgtgaatacttgggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292677 - DNA, 3028 bp, Homo sapiens
gggagctgctccgagtctggccggggcgcaccccagttccgagcgcacgccgctcaccggaactttgtggcggcgccgcaggtgtgggggcccgcggaggtgtgcatgcggggcgcgagggcgtcgcggagagcggccgctgccctgtccggcccccgctggagcagcccggaggcagcgagcaaggagaaaggtgtgtgccctcttcctgattctggagaaaaatgccggtccggaagcaagatacccagagagcattgcaccttttggaggaatatcgttcaaaactaagccaaactgaagacagacagctcagaagttccatagaacgggttattaacatatttcagagcaacctctttcaggctttaatagatattcaagaattttatgaagtgaccttactggataatccggagatttccagccttccaagctctactgtgacttcagagacactgccaagcagccttagccctagtgtagagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaagccaacagaagctgttcttccctctcctcccactgtccctgtgatccctgtcctgccagtccctgctgagaatactgtcatcctacccaccataccacaggcaaatcctcccccagtactggtcaacacagatagcttggaaacaccaacttacgttaatggcacagatgcagattatgaatatgaagaaatcacacttgaaaggggaaattcagggcttggtttcagcattgcaggaggtacggacaacccacacattggagatgactcaagtattttcattaccaaaattatcacagggggagcagccgcccaagatggaagattgcgggtcaatgactgtatattacgagtaaatgaagtagatgttcgtgatgtaacacatagcaaagcagttgaagcgttgaaagaagcagggtctattgtacgcttgtatgtaaaaagaaggaaaccagtgtcagaaaaaataatggaaataaagctcattaaaggtcctaaaggtcttgggtttagcattgctggaggtgttggaaatcagcatattcctggggataatagcatctatgtaaccaaaataattgaaggaggtgcagcacataaggatggcaaacttcagattggagataaacttttagcagtgaataacgtatgtttagaagaagttactcatgaagaagcagtaactgccttaaagaacacatctgattttgtttatttgaaagtggcaaaacccacaagtatgtatatgaatgatggctatgcaccacctgatatcaccaactcttcttctcagcctgttgataaccatgttagcccatcttccttcttgggccagacaccagcatctccagccagatactccccagtttctaaagcagtacttggagatgatgaaattacaagggaacctagaaaagttgttcttcatcgtggctcaacgggccttggtttcaacattgtaggaggagaagatggagaaggaatatttatttcctttatcttagccggaggacctgctgatctaagtggagagctcagaaaaggagatcgtattatatcggtaaacagtgttgacctcagagctgctagtcatgagcaggcagcagctgcattgaaaaatgctggccaggctgtcacaattgttgcacaatatcgacctgaagaatacagtcgttttgaagctaaaatacatgatttacgggagcagatgatgaatagtagtattagttcagggtcaggttctcttcgaactagccagaagcgatccctctatgtcagagccctttttgattatgacaagactaaagacagtgggcttcccagtcagggactgaacttcaaatttggagatatcctccatgttattaatgcttctgatgatgaatggtggcaagccaggcaggttacaccagatggtgagagcgatgaggtcggagtgattcccagtaaacgcagagttgagaagaaagaacgagcccgattaaaaacagtgaaattcaattctaaaacgagagataaagggcagtcattcaatgacaagcgtaaaaagaacctcttttcccgaaaattccccttctacaagaacaaggaccagagtgagcaggaaacaagtgatgctgaccagcatgtaacttctaatgccagcgatagtgaaagtagttaccgtggtcaagaagaatacgtcttatcttatgaaccagtgaatcaacaagaagttaattatactcgaccagtgatcatattgggacctatgaaagacaggataaatgatgacttgatctcagaatttcctgacaaatttggatcctgtgttcctcatacaactagaccaaaacgagattatgaggtagatggaagagattatcattttgtgacttcaagagagcagatggaaaaagatatccaggaacataaattcattgaagctggccagtataacaatcatctatatggaacaagtgttcagtctgtacgagaagtagcaggaaagggcaaacactgtatccttgatgtgtctggaaatgccataaagagattacagattgcacagctttaccctatctccatttttattaaacccaaatccatggaaaatatcatggaaatgaataagcgtctaacagaagaacaagccagaaaaacatttgagagagccatgaaactggaacaggagtttactgaacatttcacagctattgtacagggggatacgctggaagacatttacaaccaagtgaaacagatcatagaagaacaatctggttcttacatctgggttccggcaaaagaaaagctatgaaaactcatgtttctctgtttctcttttccacaattccattttctttggcatctctttgccctttcctctggaaaaaa

SEQ ID NO: 292678 - DNA, 624 bp, Homo sapiens
ctggctcaggggccaagggtcggagcgcttcacccgcccgtacccagtagcaggtggggagtgtggatacttgtgcgggggaagaggcggcctcaggtctaggctctttggggaggggacgctttcgaggagagtttggaagccgacttctgtctgttcttaatttggaggggtacccactccaaggaaaagctttccacgttgacagacaactgctgcgttttgagactctttctttgacttggtaaaactttggaacgtggggttttcaaataggctgcgagggttttctatttcgataggggaaaatgctagtttaacatgattctatcctttttcctttccgttgtgtgttttagtgtgtgccctcttcctgattctggagaaaaatgccggtccggaagcaaggtgagagtttattccgtaactctgttgtcgatgtcacttgcttttctgtgtgtcagttttttgattgccgttttagaatcgtttgtgtaacttttgatgagacagcacggtcctagctttattgcttagggaatctaagcctcatatcatttcagaagatggaaacacgaaaatgtttgttaaactttcttaacatttctctagtgattaagagag

SEQ ID NO: 292679 - DNA, 314 bp, Homo sapiens
cagtaatgcctctgaaaggactttcctccagaacaagtccatttaatttagaatctttatattactcacccatatacctttatttgttgtgttccttatgttagtacagtttctgcgtcctttaatgacaggaacctgtccataaagataaatcatattcagtctcaattttttttcttctatcctcagggaaattcagggcttggtttcagcattgcaggaggtacggacaacccacacattggagatgactcaagtattttcattaccaaaattatcacagggggagcagccgcccaagatggaagattgcg

SEQ ID NO: 292680 - DNA, 592 bp, Homo sapiens
atattcagtcttctctgtcacctagcttgaattatttctaatgtttaaattaaataattttattattggcattatttttaaagtaaaatcctatttcctctgagatctgatgtattaaaccataaatatactttttatattgctaaatattgagtatttggctagttatgaaaaccatgatttgaattaaactcatgttgcttatcagggcttcttcatgtttattttctttacagaaatacaggtatcaggatgaagatacacctcctcaagagcatatttccccacaaatcacaaatgaagtgataggtccagaattggttcatgtctcagagaagaacttatcagagattgagaatgtccatggatttgtttctcattctcatatttcaccaataaaggtaggatagtatctatttattattgttatgaattacatattacttttgttatacatatagctcatgctcggagagaagtattctttcatgtaggttcgccctaccccacccccccattttagtttcatagttatggagaatttcaaggtgcttattagtactccagaaaacatttttaaatatgtatttta

SEQ ID NO: 292681 - DNA, 2602 bp, Homo sapiens
ttcttgtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292682 - DNA, 2370 bp, Homo sapiens
  misc_feature (7)..(7): n is a, c, g, or t
agggaanacagattacggctaggtacgagtgctggtgtcggggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292683 - DNA, 2240 bp, Homo sapiens
ctgtgctgctccctggagtggggggaactcagcggcggggccagaccttcacagaccctccttatgtccacggagggtggattgaggtcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292684 - DNA, 2538 bp, Homo sapiens
ttcttgtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292685 - DNA, 2325 bp, Homo sapiens
  misc_feature (7)..(7): n is a, c, g, or t
agggaanacagattacggctaggtacgagtgctggtgtcggggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292686 - DNA, 1908 bp, Homo sapiens
ttcttgtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacgcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292687 - DNA, 1319 bp, Homo sapiens
gtgtgtgagtcaggaaggccgtcgccacgggcagagcgacgcgtgcggggagcgtgtgtgagtcaggagggccgtcgccacgggcacagtgacgtgcgtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292688 - DNA, 2035 bp, Homo sapiens
ttcttgtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292689 - DNA, 2046 bp, Homo sapiens
ttcttgtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagcagacgcatgtctagaagacaaaaggtacaatattcttgctgccgaagaaaagaaaaaattgccaaacctgaattgctgtgaaggacatagcttggaaggcatgacagaaggttccctgcagttatggaggatgagtatgggtgaggtgctgtggaccccagctccagtatcactgggcaagtcttgacaggacaccaaggtcatggaggtcagccttgtggagcccatgctgcactcagatgagatctgtgggtccaaacagctcaggccatctgagtttgtcctgtttgatttgcttgttatataaaatcaatcaatcaaaagatagatgagtga

SEQ ID NO: 292690 - DNA, 874 bp, Homo sapiens
aggatactcgaagtcccgttctgaacacctatcgatacttaaactgcgagcgacaaagtcacgaagggcaccgactgttgttcagcgaagtgtcttctatcctatgttgtaatacgatgtcttgtgcataactgtcatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaa

SEQ ID NO: 292691 - DNA, 404 bp, Homo sapiens
agtatggtccactgaaggagctgaaagaggtgatagaactacataggagaaaggaggaaagtgctgcaggatgaaaacctgcgttaacaaattggatagatcatgtctggagttaatacactgagacatagcaataggaggctaattaaaggtaagaggtaagtatgaaaaggatgagctaagtagtgacctcagacacatggaggtagaggtgtagtggggaaaagaagagattttattctaagcaggagattttattctaagcctttctgattgatttcctttttaccatgcatagattctactttgataattactcttaacatatttcctgtgattctgatatgcacacatcacacttacattctctgcccaaataatcattgcccaagaaatctatactt

SEQ ID NO: 292692 - DNA, 830 bp, Homo sapiens
gcggccgcggcaccctcgtcaggcgccgccgctgagggcaggcagcccggcagccactacacacggacccgtgacgtcgggcgtagcgcggcgcacgtcacggccgctcgctcgtgcgcgcgcacccctccgcccggcggtagcggaacccgccgcgggcgcgcgcccggcccaggggagtgggtcggcgcctgcgcagaggcccgccacgcccacacacaggccaccgcccccaccggccggacggcgcggggattcccagtcctggctccgccccggcctcggccccgcccctgcccctgccccggggcagcctgtgctgttccgtgtgcgcggcgcatacgcacctgggttgtctcgagcctgcggtagtggccagatcccagacatccgagtagatcccgtgaaaagcttctacttggtttcttcgtacattctggatccacccctttcatgcatattccagaccacatttccactggagcagttgaaatgagagagatgggaatgggactcacccgaaccagaggaatttttattacagacccattaacagaggtgtcaaagtcacaggaacaaggatgtgcacctcagaaacacagagctcagtggaaaatcagtttgcttctatttgtttaaaaaatgggggacttatgcataaatctaagaccttcttgaatctaacattctaagacctgtatgccacagaaaggagggtctcagaacgccggaggatagtatttaaatcttaaatatctatattgttctccacagttactgggtcaccacatagcaggcattcaataaaaacgtgtttgtttactaagtaa

SEQ ID NO: 292693 - DNA, 510 bp, Homo sapiens
gcagggacgtagagagccgcaggcccaaggaggggccgcccccgccgagcccgcccctccgccccagcgcggcctgtcaccgcggccccagcttctacttggtttcttcgtacattctggatccacccctttcatgcatattccagaccacatttccactggagcagttgaaatgagagagatgggaatgggactcacccgaaccagaggaatttttattacagacccattaacagaggtgtcaaagtcacaggaacaaggatgtgcacctcagaaacacagagctcagtggaaaatcagtttgcttctatttgtttaaaaaatgggggacttatgcataaatctaagaccttcttgaatctaacattctaagacctgtatgccacagaaaggagggtctcagaacgccggaggatagtatttaaatcttaaatatctatattgttctccacagttactgggtcaccacatagcaggcattcaataaaaacgtgtttgtttactaagtaa

SEQ ID NO: 292694 - DNA, 1399 bp, Homo sapiens
gcggccgcggcaccctcgtcaggcgccgccgctgagggcaggcagcccggcagccactacacacggacccgtgacgtcgggcgtagcgcggcgcacgtcacggccgctcgctcgtgcgcgcgcacccctccgcccggcggtagcggaacccgccgcgggcgcgcgcccggcccaggggagtgggtcggcgcctgcgcagaggcccgccacgcccacacacaggccaccgcccccaccggccggacggcgcggggattcccagtcctggctccgccccggcctcggccccgcccctgcccctgccccggggcagcctgtgctgttccgtgtgcgcggcgcatacgcacctgggttgtctcgagcctgcggtagtggccagatcccagacatccgagtagatcccgtgaaaaggtctcccacgtgggctgtggacagggcccaagggtagcagagctagcagaggcagtgacggactgtgtggcaggtcatttgcaaggagaaaagccgtctgcctcttaatttgtggctcaagtttcagaatttttttcctgagggactttagaaattacttcaggcttgccacctaaccttaaaccacccccttggagactggctaagtgttatttgtgttttctgtttagttcttatcaccatcgatacttggttatgactggttgtgtacattggttagcccagcaagtattacttctccagcttaacagatgtggaaacttaagcccagagacatgagttgacaccccacccccaaagctagagtctaaaaccctttctttcgctcctcatctcccacaggataaaatgcaaattaatcagactagtggtgaggccctccgtggtgtgactaacctgcatcccgacgttttcaccctactttgatccagaaagcacctttccgccccatctcttctcctttccttaaataccccttacaacttcctgtaccattcttccctgttcagcttctacttggtttcttcgtacattctggatccacccctttcatgcatattccagaccacatttccactggagcagttgaaatgagagagatgggaatgggactcacccgaaccagaggaatttttattacagacccattaacagaggtgtcaaagtcacaggaacaaggatgtgcacctcagaaacacagagctcagtggaaaatcagtttgcttctatttgtttaaaaaatgggggacttatgcataaatctaagaccttcttgaatctaacattctaagacctgtatgccacagaaaggagggtctcagaacgccggaggatagtatttaaatcttaaatatctatattgttctccacagttactgggtcaccacatagcaggcattcaataaaaacgtgtttgtttactaagtaa

SEQ ID NO: 292695 - DNA, 1058 bp, Homo sapiens
ggcacgagggagacggactcttgctatgttgcccaggctggtcttgaactcctggcctcaagcaatcctcctgcctcagcctcccaaagcacggggattacaaaccctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggca

SEQ ID NO: 292696 - DNA, 994 bp, Homo sapiens
ccccccaggcggcgcgaccgggccggcgctggggtaagaagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggca

SEQ ID NO: 292697 - DNA, 1229 bp, Homo sapiens
  misc_feature (1229)..(1229): n is a, c, g, or t
ccccccaggcggcgcgaccgggccggcgctggggtaagaagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggcaaaaaaaaaaaaaaaaaaaaaaaaaaaccccggggacaataaaagacggggtgggggaaaagaggggcaaggaagtggcgccctggtgccaataagcggtgcttccggagaaccccaagtttctttggttcacaacgcggggaaaaaccgcgcgggactcccccctatatagggaaggaccgcatataaatcccgaatagccccgggttaacccggataatggcgacagcgacaan

SEQ ID NO: 292698 - DNA, 987 bp, Homo sapiens
ccgggctaggtagcgaggcctgggtggctggaagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggca

SEQ ID NO: 292699 - DNA, 1315 bp, Homo sapiens
tgggtggcttaaacagcagaaattgccaggcactgtggctcacacctgtaatccaggcactttgagaggctagtctcgaacttctgaccgcaagtgatccgcccgcctcggcctcccaaagtgctgggattacgggtgtgagccaccagacctggcctaaatgagctcatttggtgtcatgatgtgaattttgccttaataaacttttacaaggagagcgctaagtccaaagcccttgttttatacagagaaggccacagaggccccaagagggtcatggctgcccaagtgtgattctgggggtgctgagtgccgatgtcccctccggcccctgctcccccatccccatcctcttcccgcagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaggaggaggactccaagctcaagggcggcaaggcgccgcgggtggccacgtccagcaaggtcacccgggcccagatcgaggacacgctgcgccgagaccatcagctcagggaggccccggacacagccgagaaagccaagagccatctggaggtgccgctggaggagaacgtgaaccgccgcgtgctggaggagggcagcgtggaggcgcgcaccatcgaggacgccattgcagtgctcagcgtggcggaggaggcggccgaccggcacccagaaagacgcatgcgggcagccttcacagcctttgaggaagcccagctgccgcggctcaaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggca

SEQ ID NO: 292700 - DNA, 985 bp, Homo sapiens
tgggtggcttaaacagcagaaattgccaggcactgtggctcacacctgtaatccaggcactttgagaggctagtctcgaacttctgaccgcaagtgatccgcccgcctcggcctcccaaagtgctgggattacgggtgtgagccaccagacctggcctaaatgagctcatttggtgtcatgatgtgaattttgccttaataaacttttacaaggagagcgctaagtccaaagcccttgttttatacagagaaggccacagaggccccaagagggtcatggctgcccaagtgtgattctgggggtgctgagtgccgatgtcccctccggcccctgctcccccatccccatcctcttcccgcagcctgctgagggatgcccaagaagttccagggtgagaacaccaagtcggcagcggcccgggcacgtagggcagaggccaaggcggccgctgatgccaagaagcagaaggagctggaggatgcctactggaaggacgacgacaaacacgtcatgaggaaggagcagcgcaaggaggagaaggagaagcggcgcctcgaccagctggaacgtaagaaggagacgcagcgcctactggaacaagagaaccccaacatgcggctgtcgcagctgaaacagctgctcaagaaggagtggctccgctctcctgacaaccccatgaaccagcgggccgtgcccttcaatgcccccaagtgagcccagaacttggggagccagttcacccacgggtggtccaggtcacgactctgcacgcccttaggccaggtcagctgcgagggtcacagagcgttccgggggccaaggcgccgggccccggggccatgctcttatcaccagccacccgtcctcccgccagagggtccctgccccgagtgacaccccatcccctcccatcccccggcgcgtgtgtgtagagcctcagggctgagtgcccaataaaggtggcggcaaggctgcggtgaggca

SEQ ID NO: 292701 - DNA, 750 bp, Homo sapiens
cagtttactccagagaagaaactgtgtctcataatttcttttgcatcatctggtcctccaccaaggctatgagaacagaaataaaattaagcacagtagataccagatgctcagagcagagcagccatggagctgctgggaccaaaccttgcctgacctagccaccaccacaccccagacatataaatttaaattttactgatataaagaatgcaaaacacaaaatttacaaagatcataaaacatacaatgttgtgtattgtaaattagtcacctgattctcacagaaaacttgttaatttctgctgtactccaaagccactaatggatgaaacttacgattagttccaacatgaatattggttgacatttttgtttatgttaaagtcaaagctgaaagtgatacaatggagacttcagaacttcacttgtcagttatttgtgtaggtttctttcccaggagactgcaaactcctttgaaggcaagatcagtgctggattatccaaaaggcattctaagcttgtgcttggggaaccagagaagcaaaagcaccaaaacacgtttctgaaaagcatttaatattttcaagcatgcgtcaacatagtctgcatgagaaacatcaaagctccatggcattttcttacacttatgttgtagtttatttcaatactgttttcatttgaattgtacttgagatgggagttggagtggagaatcataatcattttgtaaataaaatgttttaatcc

SEQ ID NO: 292702 - DNA, 464 bp, Homo sapiens
tctctaaatgaactataccccagagatggcacttttaggtttgatcataatagtgctgttcgatgtttgcatttggaattttcagactggtagttctgtgttcagtgagagctcagcatttcagaccctgccctctttttcattctatttcagttgtgtaggtttctttcccaggagactgcaaactcctttgaaggcaagatcagtgctggattatccaaaaggcattctaagcttgtgcttggggaaccagagaagcaaaagcaccaaaacacgtttctgaaaagcatttaatattttcaagcatgcgtcaacatagtctgcatgagaaacatcaaagctccatggcattttcttacacttatgttgtagtttatttcaatactgttttcatttgaattgtacttgagatgggagttggagtggagaatcataatcattttgtaaataaaatgttttaatcc

SEQ ID NO: 292703 - DNA, 608 bp, Homo sapiens
cagtttactccagagaagaaactgtgtctcataatttcttttgcatcatctggtcctccaccaaggctatgagaacagaaataaaattaagcacagtagataccagatgctcagagcagagcagccatggagctgctgggaccaaaccttgcctgacctagccaccaccacaccccagacatataaatttaaattttactgatataaagaatgcaaaacacaaaatttacaaagatcataaaacatacaatgttgtgtattgtaaattagtcacctgattctcacagaaaacttgttaatttctgctgtactccaaagccactaatggatgaaacttacgattagttccaacatgaatattggttgacatttttgtttatgttaaagtcaaagctgaaagtgatacaatggagacttcagaacttcacttgtcagttatgtgagtgatttctttgctaaatgtttagtaactttgggatggtggaagaagattcattttttggtgctatttacaatgtaatgaatctgcattattaatattttctcttaagtctaaacagtcaacaaaacagtaagcgcagccccaactcatagtatttgccaattct

SEQ ID NO: 292704 - DNA, 708 bp, Homo sapiens
atttcttttaaaacaaggatttgtataaatgaatctgaagtgttcactttaaaattaaagacataagggcaaattaaaaaattttaactagttttcttaaagaaaaattaacacttggtatctttattaaaattaaagaaataatgagaggcaaacaaattattatgggaaaaaaatagaaaaattctgtgatcatgttgagcaaaatctcaagaggcatttggggagtcaaaatcatgagtaaaattttgtgcacagaagttcaataatcacttaaatgtcggtaaaatggaaagtatcattacatcattaacttttattcacttaaaatatttttgctataaattcattttagcagtgcagccaaaatatatacacactatgccataaagaaatcttacctttttatcatatacatcttgccagtttactccagagaagaaactgtgtctcataatttcttttgcatcatctggtcctccaccaaggctatgagaacagaaataaaattaagtaagtataaaacatttacataagctcaaagcataacaaaaaatattttgtgaaagtgtaattttctgtgtaataaacagttcttgggataaatagctctaaaagtaaaaagcttttgctataagatctatttttcctaatatgcttgtaagaactagcttcagaacagtatggtatttggaaaagagcagaggc

SEQ ID NO: 292705 - DNA, 1877 bp, Homo sapiens
gtttgggtgtggccgcatggcgtgctgtggtgcaggtggccgaagggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccaggtccttgacaggcgtgcatctgggccagatccatggcaataaccttcaggttgaggctagagggcttcagatgggcagcttcgaatgacaggagcaaggcacaagaggccggaaagggagggtgacattttcagcatctataagatcaactttagaaacatttgggggttgacaaattcccatcaagctctgtggatcttgtacaactgctcaccaccggcttctcatcagcacatgattggtgcagggttctgaggatgattttgagatgttccctgatgtggtcttgtgaggagatttcatgacagatggcaggaagcttcgtggagagatttctgaagacactcctgagctcccaacaccgggcaactctcttccagaggatagtggggtggagggtagaagaagggcaaagtcagctatgtgttccaagattactgaagcaggattctggccttcctgataagaacatgaccagatccagctggtttgcaacaagatgaacttcagtgctgagctttcaccaagtttttctcactacaatctcattgtaatactaaaatctccacccaagatggaggttatctgccattttctgtacatgtgttaccagaaaggggtcctgatccagaccccaaaagagggttcttggatctcacgcaacaaagagttcggggcgagtccatagagtaaagtgaaagcaagttcatcaagaaagcaaaggaataaagaatgcctactccataggcagagcagtggctttggctgctcagctgcttgtacttgttacttcttgagtatatgctaaacaagggattgattactccttgtttagcagttttctgggaaaggagtgggcaattcccagaactgagggttcctcccctttttagaccatatagggtgacttcctgatgttgccatggcatttgtaaactgtcatggcgctagtgggagtgtcttttagcatgctaatgcatgagcagtgaggatgacccgaggtcatttttgttaccatcttggttttggtgggttttggctggttttggccggcttctttaccacttctttttatcagcaaggtctttgtgacctgtacttagtgccgacttcctgtctcatcctgtgagtaagaatgcctaatctctcaggaatgcagcccagtaggtctcaaccttattttacccagcccccattcaagatggagtgactctggttcaaatgcctctgacacatgtgcctcatgtttgggcatgagacctcactgtgtaggtgcagagaagaccctgcctaaacattgcctacacgttgctcctttttcctgcctcaacttccttaaaatgacaagagcagagcccttttgggagctaacatcaggactccttttctgtactctgctccgttgtgctgctagagccacaagcctattaaactttgcctgaaataaattcctatttgcgc

SEQ ID NO: 292706 - DNA, 2303 bp, Homo sapiens
gtttgggtgtggccgcatggcgtgctgtggtgcaggtggccgaagggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccaggtccttgacaggcgtgcatctgggccagatccatggcaataaccttcaggttgaggctagagggcttcagatgggcagcttcgaatgacaggagcaaggcacaagaggccggaaagggagggtgacattttcagcatctataagatcaactttagaaacatttgggggttgacaaattcccatcaagctctgtggatcttgtacaactgctcaccaccggcttctcatcagcacatgattggtgcagggttctgaggatgattttgagatgttccctgatgtggtcttgtgaggagatttcatgacagatggcaggaagcttcgtggagagatttctgaagacactcctgagctcccaacaccgggcaactctcttccagaggatagtggggtggagggtagaagaagggcaaagtcaggtttgtccttcggatcccccttcattctccttttgccaccgtaaaccaacttttgcttacagttagacaccagttttcggcagatgaaatccctctgatttcaggcattttgtcaattaagctgctcagcaacaataggataaacttatgaaaagaaaggagtagcagtcccacagacaaagcatccagcccctgcactgagacagtatagggaagggacttggtcctggcagacaggacagataatcaacatcctagtgggccttacacatgtgggcatattcttttccataccttcttgtctgttttaacaagctaaccccagtcacagtagcagagagagggtccatcctaacttagctgaccaggctggattcctaatcataaaaccaaaaaaggaagaacctaaccatttctctctttcagctatgtgttccaagattactgaagcaggattctggccttcctgataagaacatgaccagatccagctggtttgcaacaagatgaacttcagtgctgagctttcaccaagtttttctcactacaatctcattgtaatactaaaatctccacccaagatggaggttatctgccattttctgtacatgtgttaccagaaaggggtcctgatccagaccccaaaagagggttcttggatctcacgcaacaaagagttcggggcgagtccatagagtaaagtgaaagcaagttcatcaagaaagcaaaggaataaagaatgcctactccataggcagagcagtggctttggctgctcagctgcttgtacttgttacttcttgagtatatgctaaacaagggattgattactccttgtttagcagttttctgggaaaggagtgggcaattcccagaactgagggttcctcccctttttagaccatatagggtgacttcctgatgttgccatggcatttgtaaactgtcatggcgctagtgggagtgtcttttagcatgctaatgcatgagcagtgaggatgacccgaggtcatttttgttaccatcttggttttggtgggttttggctggttttggccggcttctttaccacttctttttatcagcaaggtctttgtgacctgtacttagtgccgacttcctgtctcatcctgtgagtaagaatgcctaatctctcaggaatgcagcccagtaggtctcaaccttattttacccagcccccattcaagatggagtgactctggttcaaatgcctctgacacatgtgcctcatgtttgggcatgagacctcactgtgtaggtgcagagaagaccctgcctaaacattgcctacacgttgctcctttttcctgcctcaacttccttaaaatgacaagagcagagcccttttgggagctaacatcaggactccttttctgtactctgctccgttgtgctgctagagccacaagcctattaaactttgcctgaaataaattcctatttgcgc

SEQ ID NO: 292707 - DNA, 1458 bp, Homo sapiens
gtttgggtgtggccgcatggcgtgctgtggtgcaggtggccgaagggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccagctatgtgttccaagattactgaagcaggattctggccttcctgataagaacatgaccagatccagctggtttgcaacaagatgaacttcagtgctgagctttcaccaagtttttctcactacaatctcattgtaatactaaaatctccacccaagatggaggttatctgccattttctgtacatgtgttaccagaaaggggtcctgatccagaccccaaaagagggttcttggatctcacgcaacaaagagttcggggcgagtccatagagtaaagtgaaagcaagttcatcaagaaagcaaaggaataaagaatgcctactccataggcagagcagtggctttggctgctcagctgcttgtacttgttacttcttgagtatatgctaaacaagggattgattactccttgtttagcagttttctgggaaaggagtgggcaattcccagaactgagggttcctcccctttttagaccatatagggtgacttcctgatgttgccatggcatttgtaaactgtcatggcgctagtgggagtgtcttttagcatgctaatgcatgagcagtgaggatgacccgaggtcatttttgttaccatcttggttttggtgggttttggctggttttggccggcttctttaccacttctttttatcagcaaggtctttgtgacctgtacttagtgccgacttcctgtctcatcctgtgagtaagaatgcctaatctctcaggaatgcagcccagtaggtctcaaccttattttacccagcccccattcaagatggagtgactctggttcaaatgcctctgacacatgtgcctcatgtttgggcatgagacctcactgtgtaggtgcagagaagaccctgcctaaacattgcctacacgttgctcctttttcctgcctcaacttccttaaaatgacaagagcagagcccttttgggagctaacatcaggactccttttctgtactctgctccgttgtgctgctagagccacaagcctattaaactttgcctgaaataaattcctatttgcgc

SEQ ID NO: 292708 - DNA, 1943 bp, Homo sapiens
  misc_feature (1919)..(1919): n is a, c, g, or t
gtttgggtgtggccgcatggcgtgctgtggtgcaggtggccgaagggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacgaaatcctggctgacattgacttctccactgcaaccatcgagttcattgtctcctaaaccttgccatggaggcctgtggcacctgagccagccattatcatcaccagcacttccatgagctacaagctggacccactgcagtcctcctgacacactgaaatcagagcctgcacacagagcagcagatgcttcaatgtaaaggtcatttccaggtccttgacaggcgtgcatctgggccagatccatggcaataaccttcaggttgaggctagagggcttcagatgggcagcttcgaatgacaggagcaaggcacaagaggccggaaagggagggtgacattttcagcatctataagatcaactttagaaacatttgggggttgacaaattcccatcaagctctgtggatcttgtacaactgctcaccaccggcttctcatcagcacatgattggtgcagggttctgaggatgattttgagatgttccctgatgtggtcttgtgaggagatttcatgacagatggcaggaagcttcgtggagagatttctgaagacactcctgagctcccaacaccgggcaactctcttccagaggatagtggggtggagggtagaagaagggcaaagtcagctatgtgttccaagattactgaagcaggattctggccttcctgataagaacatgaccagatccagctggtttgcaacaagatgaacttcagtgctgagctttcaccaagtttttctcactacaatctcattgtaatactaaaatctccacccaagatggaggttatctgccattttctgtacatgtgttaccagaaaggggtcctgatccagaccccaaaagagggttcttggatctcacgcaacaaagagttcggggcgagtccatagagtaaagtgaaagcaagttcatcaagaaagcaaaggaataaagaatgcctactccataggcagagcagtggctttggctgctcagctgcttgtacttgttacttcttgagtatatgctaaacaagggattgattactccttgtttagcagttttctgggaaaggagtgggcaattcccagaactgagggttcctcccctttttagaccatatagggtgacttcctgatgttgccatggcatttgtaaactgtcatggcgctagtgggagtgtcttttagcatgctaatgcatgagcagtgaggatgacccgaggtcatttttgttaccatcttggttttggtgggttttggctggttttggccggcttctttaccacttctttttatcagcaaggtctttgtgacctgtacttagtgccgacttcctgtctcatcctgtgagtaagaatgcctaatctctcaggaatgcagcccagtaggtctcaaccttattttacccagcccccattcaagatggagtgactctggttcaaatgcctctgacacatgtgcctcatgtttgggcatgagacctcactgtgtaggtgcagagaagaccctgcctaaacattgcctacacgttgctcctttttcctgcctcaacttccttaaaatgacaagagcagagcccttttgggagctaacatcaggactccttttctgtactctgctccgttgtgctgctagagccacaagcctattaaactttgcctgaaataaattcctatttgcgcaaaaaaaaaaacactggccgcggtttcaacgtctggactggnccctggcgtacccctttcgccttg

SEQ ID NO: 292709 - DNA, 948 bp, Homo sapiens
gtttgggtgtggccgcatggcgtgctgtggtgcaggtggccgaagggggcgttactgttgcgactggcatccgcatccggcagatgtagatggaaccaaagtccagaagttacgcgtcacccttgctctacagccaaacatgcaggactctagtaacccgcgaaatgatgggatagcgttgcaaatccttaaaagagtcttaacggagaagggaaaatgttacattgtcaaagtcccaaagcctttcagcctgaagccaggaacaattgttcaaagtttctttggaacatcaaggaaggaaatccagattttactttaagtgcaatggggagtcattaaggattttgtgtagatacagcaaaaagacaacaatcttcaagccacaatggccctcaccagaacccagccatgtggtcagcctgatctcggacttcacagccagcagaactgtttgtcaaagatcagatggtttccttaagctgataagcaacttcaacaaagtctcaggatacaaaatcaatgtgcaaaaatcataagcattcttatacaccaataacagacaaacagccaaatcatgagtgaacttccattcataattgcacaaagagaatcaaatacctaggaatccagcttacaagggatgtgaaggacctcttcaaggagaactacaaaccactgctcaatgaaataaaaggggacacaaacaaatggaagaacattccatgctcatggttaggaagaatcaatatcgtgaaaatggccatactgcccaagataatttatagattcaatgccatccccatcaagctaccaatgactttcttcacagaattggaagaaactacgttaaagttcatatggaaccagaaaagagcctgcactgccaagacaaccctaagcaaaaagaacaaagctggaggcatcatgccacctgacttcaaactatac

SEQ ID NO: 292710 - DNA, 616 bp, Homo sapiens
ttatcagcaaggtctttgtgacctgtacttagtgccgacttcctgtctcatcctgtgagtaagaatgcctaatctctcaggaatgcagcccagtaggtctcaaccttattttacccagcccccattcaagatggagtgactctggttcaaatgcctctgacacatgtgcctcatgtttgggcatgagacctcactgtgtaggtgcagagaagaccctgcctaaacattgcctacacgttgctcctttttcctgcctcaacttccttaaaatgacaagagcagagcccttttgggagctaacatcaggactccttttctgtactctgctccgttgtgctgctagagccacaagcctattaaactttgcctgaaataaattcctatttgcgctggtgttaatttttacttatgagtgagccaagaactcaggccagagttgcggtaacaccaccagaagaggtctccgcttgtcagacttgagggatatcatcaatgagcctctgagctaatggtgtaaaccaaaaataaaattctaagccccccgccagccaaaccatctgaatggacttcctcctcagccagggtgctcttaaaatttaacctgagagactggttc

SEQ ID NO: 292711 - DNA, 1961 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292712 - DNA, 1318 bp, Homo sapiens
tattcaaggcacaaagaaatgcagtaacttcctaaaggtttcacattgctgatctgtggttgagctggaattccaaccctgtctgaaggactgtggagctctcgggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagataccacttgttttttagggattagccactctactagatttaatccttctgaaatcttgtctgactatagtcttgtctgactatagtgttttaatgctggactgtttattgaaacagcaggaagtgattcctgatagcaaaagttccaaagcgtcagcccatcgcagttcctgctattctggttggtagcatgtaatttgtaatgcattcagaatccagttcattattttactcccatttagcaacagattgagaaagcacgtaatagtaaagccagctccttctaactctgaggccagcctctgccaactgaaggattctccccacagtcagcttcttctatgaactctgaagttttggcttaagacaaccacattgatactaaacaaggggaaacttttcttagaacaaaactaaaactgtgaaacagattccacattatctgggcacaatgaatcagataaaatgaaatataaaattaaggcaaagtctgtaaatggattcatgtcttaacagataaactcaggaggaataatttttatgtgatgtggtttaattggaagtgtcagaatctgaggaaactatagtgaaggactttattattactgaaaatataacctgggattataactattgttttttgcagtattttgcataagatgtttccttctcattgtgctccgttaatgaattacgtaaacttctaataatcctgaatctttttttgcatagcatatattccctgttagtatatgtcccattatatatccatctgtggtatctatgttccccttgctaggagtgagctctttaagagtgaggactgtgccctagtcatcttcatatccctgata

SEQ ID NO: 292713 - DNA, 1015 bp, Homo sapiens
cgcgggaggggcagcggaacgcgcagagggcacggtgcaagcacgggacagctctgcattggccaaagggatcccaggaggcctggccctcttttctcctgaggctggatcccaaccagcaggaaaaggctggattttcgccttttgtatttgttttggggcccaaccaagaaaaacagtggagggggaataaaacatgtttaaatcttttttttgtcttaaaaccatctttaatttcacagtcacaaaatggacttaactcgaatgttagatgtttgcagtgacatcgatgtaaaagggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaaccccttttccttta

SEQ ID NO: 292714 - DNA, 378 bp, Homo sapiens
ttttataaggggtggggggataagaaatgaaacaggtgtcctgggcctagacagattcatttccagtagtaactaggcaactctagggtgtagaaggaaaaatactagattgccttctgtagttttcattcctactctcctcctcttcttccagggtgattgtagagaaggctccaaaagccagggtgcctgatctggacaagaggaagtacctagtgccctctgaccttactggtaatgctctttgccttccctgacccttcctccggtgaaaaaactctctagatcctcattacatgcatgagattgtgagattgagaggcagtacatacttgaaggaagtgagtgggattataggcgtgaccgctgcacccagcc

SEQ ID NO: 292715 - DNA, 1880 bp, Homo sapiens
  misc_feature (85)..(85): n is a, c, g, or t
aaaagaaaaaagaacaagaaagaacaaaaaaacaggcaggtacggaccggaaaacccgggaaggcaaacacacccgaaaaaaccnccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292716 - DNA, 2100 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292717 - DNA, 1572 bp, Homo sapiens
ggttccccccaggtggaattttgggttaaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292718 - DNA, 1566 bp, Homo sapiens
aacgcagggacattgggctgtgcggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292719 - DNA, 1952 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggacccgcctcaagtccctgcgtgtataaaagacatgttggttaatgtttgtaaaccccaagggttcattatagcggggggaatgtgtttgtcagctccggtaacctaaagttagggaataagggtggaatcaccctaggaccattcagatatgtcaggtggttaca

SEQ ID NO: 292720 - DNA, 1821 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292721 - DNA, 1740 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292722 - DNA, 1671 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattccactctcgggggtgatactctaggaactaggctcatcacgatatacacggatgcactcgccgtcgtc

SEQ ID NO: 292723 - DNA, 896 bp, Homo sapiens
gctcggtacccatccgacagctctgtcctgacatgctgtctccctgggccgaggaagcagcaaataatatcaattgagcatgtgaaaatgtgatgacggtgtgtgtggtgtaatgtttctagatgtcttcaccttctgtctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292724 - DNA, 710 bp, Homo sapiens
cacctagaggatcctagggtctagggagacaacacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292725 - DNA, 365 bp, Homo sapiens
tcttgcagcgtcgtctctagcaggatcccctccttctgcacgcgcacggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292726 - DNA, 959 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaaccccttttccttta

SEQ ID NO: 292727 - DNA, 666 bp, Homo sapiens
aaaaggttcagaagctattcagtaattttcttgcattacagggggttaggggagcacaagacagtcctggcctggaaaacaaggtcacgttctctgcccaacagccctcttgcctcatcgttctaggctccggggcttgtgtggggacagccagcctcctcgtgttgatttctgatcacctggtacctggtcgcgataaggcaggactgagacgttttttctccgttttggacaccggcttaagtagttaaaactaccgcaggcagtgagtaggaacagaaaagtattaggtatctttcagcatccgggcgttttccccattaccccctcccccgcccacttgcctggtgtttctctaatgcaggctgcgcagccgaattggagggcagaatatggcttaagtggtagggggaccagcagctgttggattttggaaatggaggagcggagattttaaaattgtgctctttatcttcaggtaggaacattagtattacgtgtcacataatggtaaaataattgctgttatctgatgtcttttcttgactcacagccactctgggtttcttctctaatccttacctaacgttcgtggttttatagctaccagaagccaccagggccttagcccagcagtagaaacctcttgtaaccccttttccttta

SEQ ID NO: 292728 - DNA, 2290 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatcaaaaaaaaaaaaaaaaaaaaaaaaaaaaaaaaaaaaaaaaaacaaaaaacaacagaaaagccacaccaagacgacctcaccaacaggacaacacgccaaaccccacccacaagcgagaagaaagaaaaaacagacaccacatgaacagcgcgagggccagaccacaacattgcacgcgagggacgatcaacagaccagcagacgagcactgaagaagcgaacgccgcgagagactaaccacccaccacacagggcgccccaaaccacgagcgaagaaaagccgcagaaggcagaaaaacaactgaggaaacgcaccgaacacagcagcc

SEQ ID NO: 292729 - DNA, 1599 bp, Homo sapiens
cgctgggagcgggagccgccgccgccgccggagctaacctcggggaccgagatgcaggtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292730 - DNA, 1377 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcgcgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292731 - DNA, 1770 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292732 - DNA, 1769 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggaaagaggtgtcttatgtagggagggggcaagtatgaagtaaggtaattatatactactctcattgtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaatc

SEQ ID NO: 292733 - DNA, 1632 bp, Homo sapiens
actggacgcataacgcatgggcgggctgggctgatgctcgcgggggtgacgtcacagcccgacgcgccacccagctgtttttgtgctcccagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggtaatggttctggttgcacaatactggatgccgtccagtgcagtctggcatcctctagcccttgttctagatgcgttgataacacatctgagaagtggggcagaaggtgttatttatccggatcctcttacatatggcagtgtaaggctctgagagattagataccacttgttttttagggattagccactctactagatttaatccttctgaaatcttgtctgactatagtcttgtctgactatagtgttttaatgctggactgtttattgaaacagcaggaagtgattcctgatagcaaaagttccaaagcgtcagcccatcgcagttcctgctattctggttggtagcatgtaatttgtaatgcattcagaatccagttcattattttactcccatttagcaacagattgagaaagcacgtaatagtaaagccagctccttctaactctgaggccagcctctgccaactgaaggattctccccacagtcagcttcttctatgaactctgaagttttggcttaagacaaccacattgatactaaacaaggggaaacttttcttagaacaaaactaaaactgtgaaacagattccacattatctgggcacaatgaatcagataaaatgaaatataaaattaaggcaaagtctgtaaatggattcatgtcttaacagataaactcaggaggaataatttttatgtgatgtggtttaattggaagtgtcagaatctgaggaaactatagtgaaggactttattattactgaaaatataacctgggattataactattgttttttgcagtattttgcataagatgtttccttctcattgtgctccgttaatgaattacgtaaacttctaataatcctgaatctttttttgcatagcatatattccctgttagtatatgtcccattatatatccatctgtggtatctatgttccccttgctaggagtgagctctttaagagtgaggactgtgccctagtcatcttcatatccctgata

SEQ ID NO: 292734 - DNA, 504 bp, Homo sapiens
gccagcatcatacaagtttcacaaaaagaaatcaagatggggcctcatcatgttgcccaggctggtctctaactcctggactcaagccatcctcctgcatcagtactgcaaaggtactacggatcacttgagctagatgtggatgatgagcaaaactggaccaagcaaatgaaggaaacaccataggtgtggcaaagcagcaagatagaaggaagccaagtcccaacatcctgtagttccataccaactctgatggcttcgtagaatggacttatcattctaacctggactttaaatgcgagggggaaaaaaatccatgaaaaattattcaaggcagatgattataatattttagacttttggttagggcaattgagagaattcatcactaaggggcagaaaactcaactaaatcaaaactccaggccaagagtaccactctgaaggctgctaggcttgctaagtttttctatttctgtgtgtgtgtgtgtgtgtgtgtgtgcg

SEQ ID NO: 292735 - DNA, 825 bp, Homo sapiens
cattaggactgtacttggctgtgagtaacaaagtcggcagcaacagcttaaacaaactttctgtctctattacatactacgcaaatcaagggagagccctacaaaagttacagaagggaacagccagaggacaaggacaccatgttcttcatcctcatgcaagacatctgacctgttcttctgagaggaatcccaggaacaacacacgctctctcagcctccagccggatcagttctgagtgttctcaagcccaaccaatgattgagggggcactgtcaatctcttgctgcaatcatcaaggattgtttgtcatgtatgcactgacctctttggaattccatcatgcaaagtgcgcttgcttgtctttgctttcattatagttacccacaataactcatacctttgcactcattttccgagaacttgtaggacaccattatttgctgtctcctatagccaggcatttcatcctctgcatctggaaacagggccagcttcagggatatacaacctgcacagttacacagggccccccactcagaaggaccccaaacttggtttcattctgtgctgctgccatcttgaaaggcttaatcgttttttcaacaacggcattgcattttcattttgcacggagccctgcaaattatgtagttgatcctgtctagaagactaactgcttcaaggtgaatttctatcaagccctgtctttacacctgggatgggagccattacagactggttctgagtacagcttttagccccagtgatcattttcattgccattcacttggtagggtgactattaccaacctaaaagttca

SEQ ID NO: 292736 - DNA, 453 bp, Homo sapiens
cttgaccttattgagacttgaccttttgcttttccatgcatagactttctgtctctattacatactacgcaaatcaagggagagccctacaaaagttacagaagggaacagccagaggacaaggacaccatgttcttcatcctcatgcaagacatctgacctgttcttctgagaggaatcccaggaacaacacacgctctctcagcctccagccggatcagttctgagtgttctcaagcccaaccaatgattgagggggcactgtcaatctcttgctgcaatcatcaaggattgtttgtcatgtatgcactgacctctttggaattccatcatgcaaagtgcgcttgcttgtctttgctttcattatagttacccacaataactcatacctttgcactcattttccgagaacttgtaggacaccattatttgctgtctcctatagccaggcat

SEQ ID NO: 292737 - DNA, 936 bp, Homo sapiens
cacatccttaccgtcacttccgctcaacgggaccgaaaaaaaaaaccttcagtgttaccggcaaacactggtccacgctgatgaagtggcttcatgatgtcatcaatatccctggctcctctttctgcaagcagcttttactccctggctccctctcagtcacaagactttctgtctctattacatactacgcaaatcaagggagagccctacaaaagttacagaagggaacagccagaggacaaggacaccatgttcttcatcctcatgcaagacatctgacctgttcttctgagaggaatcccaggaacaacacacgctctctcagcctccagccggatcagttctgagtgttctcaagcccaaccaatgattgagggggcactgtcaatctcttgctgcaatcatcaaggattgtttgtcatgtatgcactgacctctttggaattccatcatgcaaagtgcgcttgcttgtctttgctttcattatagttacccacaataactcatacctttgcactcattttccgagaacttgtaggacaccattatttgctgtctcctatagccaggcatttcatcctctgcatctggaaacagggccagcttcagggatatacaacctgcacagttacacagggccccccactcagaaggaccccaaacttggtttcattctgtgctgctgccatcttgaaaggcttaatcgttttttcaacaacggcattgcattttcattttgcacggagccctgcaaattatgtagttgatcctgtctagaagactaactgcttcaaggtgaatttctatcaagccctgtctttacacctgggatgggagccattacagactggttctgagtacagcttttagccccagtgatcattttcattgccattcacttggtagggtgactattaccaacctaaaagttca

SEQ ID NO: 292738 - DNA, 601 bp, Homo sapiens
  misc_feature (39)..(39): n is a, c, g, or t
  misc_feature (44)..(44): n is a, c, g, or t
tattctacagttagttaacgttcaaaatgcgtaaaaacnaacgnacagcctttagttagaatgataagtccattttacgaagccatcagagttcgtatggaactacaggatgttgggacttggcttccttctatcttgctgctttgccacacctatggtgtttccttcatttgcttggtccagttttgctcatcatccacatctagctagttgaagaaaagagaaaatgaggaacttagagttagctcttgtccagcttaagccggctgagaccaacaactcttcaactgggcctgcatgagtgtccaatgggtgaccttttggcatcacatgaccaagagctccaccctcagatcatgctaaagctgcaattttgtggacatgtgtcctatgaagagctatgaagcttgactatgcttgtgcacatcaccagttgcctcactgtttcttaccccaattacctttccccatgcctcagaccaccttgctcctttatcccataaataccctaaaaccccgtctttgggagctagatttgagatctgtcctcctgtctcctcacttggctgcttcatgaataaaccctttctctgcagcaaaa

SEQ ID NO: 292739 - DNA, 630 bp, Homo sapiens
  misc_feature (39)..(39): n is a, c, g, or t
  misc_feature (44)..(44): n is a, c, g, or t
tattctacagttagttaacgttcaaaatgcgtaaaaacnaacgnacagcctttagttagaatgataagtccattttacgaagccatcagagttcgtatggaactacaggatgttgggacttggcttccttctatcttgctgctttgccacacctatggtgtttccttcatttgcttggtccagttttgctcatcatccacatctagctagttgaagaaaagagaaaatgaggaacttagagttagctcttgtccagcttaagccggctgagaccaacaactcttcaactgggcctgcatgagtgtccaatgggtgaccttttggcatcacatgaccaagagctccaccctcagatcatgctaaagctgcaattttgtggacatgtgtcctatgaagagctatgaagcttgactatgcttgtgcacatcaccagttgcctcactgtttcttaccccaattacctttccccatgcctcagaccaccttgctcctttatcccataaataccctaaaaccccgtctttgggagctagatttgagatctgtcctcctgtctcctcacttggctgcttcatgaataaaccctttctctgcagcaaaaaaaaaataaaatgtcctcgctggcctcac

SEQ ID NO: 292740 - DNA, 959 bp, Homo sapiens
aatcacttgaacccaggaggtggaggttgcagtgagccgagatcatgccactacacttcagcctggccaatagagtgagactctgtctcaaaaacaaacaaacaaacagaaaaaaaacaaaaaacaaaaaacaaagaaccagtttgggttttggcagaaatcacatcaggaatattacacgaccccagtaggtaaccctgagtgctcaggtctgagctgaggtctcagtcttttatggcttcatgaaaggactgtgccctcagggaggggaccatggcttggcttgtggggtcttggtgatgactgccatctttcttcatcaccacacccagcttcttgctggcatttgcgaggagacagcagcagataagaggttcaccctttatctcccagtgagcaagatgcttccctgttcagagaggaagtaacactgcttatgcttgactgctgttttttttttttggtcttttgtttgcttttcttttgattggaattctgtatttaagatgttaagttgtgtcagcttacatatggaacattccaggagaggtgactggccccccaccctgcttggcagtggatttctgcatcaccagcttcagaagtgtccctgttcgctagtctgttgtttgcttgctttgtaaatactttggtcccaagctgagacaattgctgtgtaaaacgggaagagtcaatcttgaagggtattatttttcagaagaatttgccgtgtgccttcaccgaaggcagtcaagtctgcagttggatttttctcactagggaatgacaggaaacggggataattttgcactgtggatatattacaggagttgtctatacgattatagtacctgattctttggacatatcattgaactccgaaatgaattcaacctccaggtttaatgaaatctctgatgttactggaaaaaaaaaaaaggaatgaacatcagttctac

SEQ ID NO: 292741 - DNA, 511 bp, Homo sapiens
gacattgcctgtcatcagatggaatgcacgcgaccctggctcagcaaactgcaaacagcctggagtctgcctgtggggagcggtcgaccaatgacgcctgagtggctgctgcctgcgccagagctgcaggggaggctcggtgctgggaagaatgcacgttccagggccctctttcagcctctctcaagcctgaatttgggaagactgcggccagtaaaaatgctccataaaatgttccacatggtttccggcgcgcgtgcgctctgtgaaatggctcgagaagcgattagcacgaccatccctcacatacttacatttttttgtggtgagaacatttaaagcccactctttccagttcttaagtatgcattaatagctgtaatcaccatgttgtacatcagagctccagaacttactcatcttagagctgaaactttgtgctctctggccggcgtctctgctgccccctccagcccctggtaaacaccctaccgctctggatttcatgagt

SEQ ID NO: 292742 - DNA, 995 bp, Homo sapiens
gccctgctggtgctgggagtagggcgcaagatgtcggcggatgcagctccgaggaggtaggcagtgggagccggcgttcagtccggcccgtgccaacagtggttcctctctcccccgtagttcgaggagaccacgcgctgcccctctggcacgatcgtggatgaaccccctggcaactgaaatgggaaaggcagcgcccccgactctggggactggaccgaagtccacggtagtgacagctgccagaccctgaggagaggacgagaagacccgaggcctctgctacgaacactggcagccgatggaaaattcagacggatttgggacagtatgcagagttctccaagcgacagattaacagaggctcttgaagaataactgcgtaatcacgtgttctgctcaaaagaaggcctgaatgcccagtgccttatttggctttcagggttggtgaaagaaaaagcaaagtagatgctttctaatgctaagtcatttaatgtagcaccattccttgaacttctttcatctctaaggtcgtccctttcacctgatgatgacctttgggccatcgtacaggcatgtgtaaacttggagatcttcctcaacattgcaccatatcttgggttcattcaaggcagagtctccttgcaaaagcattctaaaacaatgtaaagtcgaagagagtagagcaatacctccatagttggaaaatgtggaggaggccaattaagggacagaaaaagaagtgcagagaatcttggaattgttgcaaaattattctggagatatttctaagtctcctctatccttttccttagtgattaatacaggtttttatattaagtggacagtaaaatccaaacagaaagaggtatatgtcgtataatgaagcctatgttcaaagtatatctgaaatttgtttttataatgtctttcttgagagcttataaagatgtcagtattctgtgggaaacaaattggcacatgcataaaagaga

SEQ ID NO: 292743 - DNA, 1695 bp, Homo sapiens
gccctgctggtgctgggagtagggcgcaagatgtcggcggatgcagctccgaggaggtaggcagtgggagccggcgttcagtccggcccgtgccaacagtggttcctctctcccccgtagttcgaggagaccacgcgctgcccctctggcacgatcgtggatgaaccccctggcaactgaaatgggaaaggcagcgcccccgactctggggactggaccgaagtccacggtagtgacagctgccagaccctgaggagaggacgagaagacccgaggcctctgctacgaacactggcagccgatggaaaattcagacggatttgggacagtatgcagagttctccaagcgacagattaacagaggctcttgaagaataactgcgtaatcacgtgttctgctcaaaagaaggcctgaatgcccagtgccttatttggctttcaggacagggtcttgcggtgtcacccaggctagagtacagtggtgcaatcatagctcactgctgcctcaaactcctagactcaagcgatcctcctgcttcagcctcccgagtagctgggactacaggtagatgatgggctccacgggaacagagcaaacgttcgctcctgctcctacacggtgtttcctctaaacctgaggctcagccgacttgtcatcacttaaaacccaattcagagcggggggcactgccagtgaatagttcatcaccgactcagtttccccatgtgtatgctgtggtattggatcagcaacgagataagaagatctctcccatttccaagcgtctatgatgattctgaggcacaaggtcacatttgacagtactaggaaacccaggaaacaagaagcaaagatgacaaaggctgtgtctgcctgggcagacgatctatttggacaagataatagacccaggcatggacatgctctccaagaaagatgccctgacagctgctcacactgaagctgaatcgaacattccaatccttagaggttccagcgaagatcttgaagtctccctgagccattgacacaatggccatgccatcccagtgataaaacacaaattgtggccttgttttggacagaaataaagagcccagtttgttagtgatttactgataataactgaatcgagtactaatacttggcgattttaaaagccatcatgttaaaaagaccacctgattcccagtgaccctgcagtgactgggtttgggcagctcgtcccctgcacctgtttggggctgtgccagccacttccagtgagaacatcgcattaacttgcggtcgcagacctggctggaccccttgaaccaaattcctttctgaccttatcagaccccaaataaaagagctcaccaggcccctcagcctacgtgacccacctgcccagtgaaaaaagtagggccctgttctgttctctgaggatggtcagtgtgctctttgatgaaaacggtttctaagctgaggcctgagacctagatcattgttctcacagcgtgtgcttgaccagccacaccagaagcacccaggctgctggctaaaaacactgatgctggggcccaccctagcccctgggtagggggtagagacctaaggtttggcatttttacaagctcctagggtgattcttagatgccctgatgattgagaaccactgctcgagcttcttaaatggctgctgaagaatgatt

SEQ ID NO: 292744 - DNA, 1236 bp, Homo sapiens
gccctgctggtgctgggagtagggcgcaagatgtcggcggatgcagctccgaggaggtaggcagtgggagccggcgttcagtccggcccgtgccaacagtggttcctctctcccccgtagttcgaggagaccacgcgctgcccctctggcacgatcgtggatgaaccccctggcaactgaaatgggaaaggcagcgcccccgactctggggactggaccgaagtccacggtagtgacagctgccagaccctgaggagaggacgagaagacccgaggcctctgctacgaacactggcagccgatggaaaattcagacggatttgggacagtatgcagagttctccaagcgacagattaacagaggctcttgaagaataactgcgtaatcacgtgttctgctcaaaagaaggcctgaatgcccagtgccttatttggctttcaggacagggtcttgcggtgtcacccaggctagagtacagtggtgcaatcatagctcactgctgcctcaaactcctagactcaagcgatcctcctgcttcagcctcccgagtagctgggactacaggtagatgatgggctccacgggaacagagcaaacgttcgctcctgctcctacacggtgtttcctctaaacctgaggctcagccgacttgtcatcacttaaaacccaattcagagcggggggcactgccagtgaatagttcatcaccgactcagtttccccatgtgtatgctgtggtattggatcagcaacgagataagaagatctctcccatttccaagcgtctatgatgattctgaggcacaaggtcacatttgacagtactaggaaacccaggaaacaagaagcaaagatgacaaaggctgtgtctgcctgggcagacgatctatttggacaagataatagacccaggcatggacatgctctccaagaaagatgccctgacagctgctcacactgaagctgaatcgaacattccaatccttagaggttccagcgaagatcttgaagtctccctgagccattgacacaatggccatgccatcccagtgataaaacacaaattgtggccttgttttggacagaaataaagagcccagtttgttagtgatttactgatacacacacacaccccaccccccacaaaaaacccgggggcgccctcttcgcgggggcgcgcggaaaacacggggtcctcaccgggcccttggctccatacctgtttccgtgcccct

SEQ ID NO: 292745 - DNA, 1923 bp, Homo sapiens
gccctgctggtgctgggagtagggcgcaagatgtcggcggatgcagctccgaggaggtaggcagtgggagccggcgttcagtccggcccgtgccaacagtggttcctctctcccccgtagttcgaggagaccacgcgctgcccctctggcacgatcgtggatgaaccccctggcaactgaaatgggaaaggcagcgcccccgactctggggactggaccgaagtccacggtagtgacagctgccagaccctgaggagaggacgagaagacccgaggcctctgctacgaacactggcagccgatggaaaattcagacggatttgggacagtatgcagagttctccaagcgacagattaacagaggctcttgaagaataactgcgtaatcacgtgttctgctcaaaagaaggcctgaatgcccagtgccttatttggctttcaggacagggtcttgcggtgtcacccaggctagagtacagtggtgcaatcatagctcactgctgcctcaaactcctagactcaagcgatcctcctgcttcagcctcccgagtagctgggactacaggtagatgatgggctccacgggaacagagcaaacgttcgctcctgctcctacacggtgtttcctctaaacctgaggctcagccgacttgtcatcacttaaaacccaattcagagcggggggcactgccagtgaatagttcatcaccgactcaggtgagtttgggaagttgaaatttgcaggggtgagtgacgggttaatacaagtgggcacagaagcattgacaaagctgtctgtgaagccctcctgctgttctaagatgatggattagagcccaaggggatccttggtgttacctttgaggttccagccatggaggcaagtagggattgggctccagttctcctcctgtcactaatttgccttcgtttttggggcctcagtttccccatgtgtatgctgtggtattggatcagcaacgagataagaagatctctcccatttccaagcgtctatgatgattctgaggcacaaggtcacatttgacagtactaggaaacccaggaaacaagaagcaaagatgacaaaggctgtgtctgcctgggcagacgatctatttggacaagataatagacccaggcatggacatgctctccaagaaagatgccctgacagctgctcacactgaagctgaatcgaacattccaatccttagaggttccagcgaagatcttgaagtctccctgagccattgacacaatggccatgccatcccagtgataaaacacaaattgtggccttgttttggacagaaataaagagcccagtttgttagtgatttactgataataactgaatcgagtactaatacttggcgattttaaaagccatcatgttaaaaagaccacctgattcccagtgaccctgcagtgactgggtttgggcagctcgtcccctgcacctgtttggggctgtgccagccacttccagtgagaacatcgcattaacttgcggtcgcagacctggctggaccccttgaaccaaattcctttctgaccttatcagaccccaaataaaagagctcaccaggcccctcagcctacgtgacccacctgcccagtgaaaaaagtagggccctgttctgttctctgaggatggtcagtgtgctctttgatgaaaacggtttctaagctgaggcctgagacctagatcattgttctcacagcgtgtgcttgaccagccacaccagaagcacccaggctgctggctaaaaacactgatgctggggcccaccctagcccctgggtagggggtagagacctaaggtttggcatttttacaagctcctagggtgattcttagatgccctgatgattgagaaccactgctcgagcttcttaaatggctgctgaagaatgatt

SEQ ID NO: 292746 - DNA, 1554 bp, Homo sapiens
gcttgagccaccatgcccagcttcaacctattctttatgggccaggtaaatacctcttcccccaggaagcctaccttgaccgtgttagcccattgagctctcacctgcctttctctttgtattacctattccactgatttgcccctgagcacggacagccctggcgtttatgcggacatctgccttgttgtctcaggtagatgatgggctccacgggaacagagcaaacgttcgctcctgctcctacacggtgtttcctctaaacctgaggctcagccgacttgtcatcacttaaaacccaattcagagcggggggcactgccagtgaatagttcatcaccgactcaggtgagtttgggaagttgaaatttgcaggggtgagtgacgggttaatacaagtgggcacagaagcattgacaaagctgtctgtgaagccctcctgctgttctaagatgatggattagagcccaaggggatccttggtgttacctttgaggttccagccatggaggcaagtagggattgggctccagttctcctcctgtcactaatttgccttcgtttttggggcctcagtttccccatgtgtatgctgtggtattggatcagcaacgagataagaagatctctcccatttccaagcgtctatgatgattctgaggcacaaggtcacatttgacagtactaggaaacccaggaaacaagaagcaaagatgacaaaggctgtgtctgcctgggcagacgatctatttggacaagataatagacccaggcatggacatgctctccaagaaagatgccctgacagctgctcacactgaagctgaatcgaacattccaatccttagaggttccagcgaagatcttgaagtctccctgagccattgacacaatggccatgccatcccagtgataaaacacaaattgtggccttgttttggacagaaataaagagcccagtttgttagtgatttactgataataactgaatcgagtactaatacttggcgattttaaaagccatcatgttaaaaagaccacctgattcccagtgaccctgcagtgactgggtttgggcagctcgtcccctgcacctgtttggggctgtgccagccacttccagtgagaacatcgcattaacttgcggtcgcagacctggctggaccccttgaaccaaattcctttctgaccttatcagaccccaaataaaagagctcaccaggcccctcagcctacgtgacccacctgcccagtgaaaaaagtagggccctgttctgttctctgaggatggtcagtgtgctctttgatgaaaacggtttctaagctgaggcctgagacctagatcattgttctcacagcgtgtgcttgaccagccacaccagaagcacccaggctgctggctaaaaacactgatgctggggcccaccctagcccctgggtagggggtagagacctaaggtttggcatttttacaagctcctagggtgattcttagatgccctgatgattgagaaccactgctcgagcttcttaaatggctgctgaagaatgatt

SEQ ID NO: 292747 - DNA, 1500 bp, Homo sapiens
gcttgagccaccatgcccagcttcaacctattctttatgggccaggtaaatacctcttcccccaggaagcctaccttgaccgtgttagcccattgagctctcacctgcctttctctttgtattacctattccactgatttgcccctgagcacggacagccctggcgtttatgcggacatctgccttgttgtctcaggtagatgatgggctccacgggaacagagcaaacgttcgctcctgctcctacacggtgtttcctctaaacctgaggctcagccgacttgtcatcacttagtgagtttgggaagttgaaatttgcaggggtgagtgacgggttaatacaagtgggcacagaagcattgacaaagctgtctgtgaagccctcctgctgttctaagatgatggattagagcccaaggggatccttggtgttacctttgaggttccagccatggaggcaagtagggattgggctccagttctcctcctgtcactaatttgccttcgtttttggggcctcagtttccccatgtgtatgctgtggtattggatcagcaacgagataagaagatctctcccatttccaagcgtctatgatgattctgaggcacaaggtcacatttgacagtactaggaaacccaggaaacaagaagcaaagatgacaaaggctgtgtctgcctgggcagacgatctatttggacaagataatagacccaggcatggacatgctctccaagaaagatgccctgacagctgctcacactgaagctgaatcgaacattccaatccttagaggttccagcgaagatcttgaagtctccctgagccattgacacaatggccatgccatcccagtgataaaacacaaattgtggccttgttttggacagaaataaagagcccagtttgttagtgatttactgataataactgaatcgagtactaatacttggcgattttaaaagccatcatgttaaaaagaccacctgattcccagtgaccctgcagtgactgggtttgggcagctcgtcccctgcacctgtttggggctgtgccagccacttccagtgagaacatcgcattaacttgcggtcgcagacctggctggaccccttgaaccaaattcctttctgaccttatcagaccccaaataaaagagctcaccaggcccctcagcctacgtgacccacctgcccagtgaaaaaagtagggccctgttctgttctctgaggatggtcagtgtgctctttgatgaaaacggtttctaagctgaggcctgagacctagatcattgttctcacagcgtgtgcttgaccagccacaccagaagcacccaggctgctggctaaaaacactgatgctggggcccaccctagcccctgggtagggggtagagacctaaggtttggcatttttacaagctcctagggtgattcttagatgccctgatgattgagaaccactgctcgagcttcttaaatggctgctgaagaatgatt

SEQ ID NO: 292748 - DNA, 1252 bp, Homo sapiens
tacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgtt

SEQ ID NO: 292749 - DNA, 2588 bp, Homo sapiens
tacgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtgggaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttct

SEQ ID NO: 292750 - DNA, 2128 bp, Homo sapiens
tacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatggtgagtatagactgcaagtgattatttattaattccaacattagaaagaccaaggtgatcaccattggtag

SEQ ID NO: 292751 - DNA, 659 bp, Homo sapiens
atggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtgtttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaata

SEQ ID NO: 292752 - DNA, 2565 bp, Homo sapiens
tacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttct

SEQ ID NO: 292753 - DNA, 2959 bp, Homo sapiens
tacgttatccatgaagtgtcgcgagagaaacggacgccgttctctcccgcggaattcaggtttacggccctgcgggttctcagagaatttctagaatttggaatcgagtgcattttctgacatttgagtacagtacccaggggttcttggagaagaacctggtcccagaggagcttgactgaccataaaaatgagtactgcagatgcacttgatgatgaaaacacatttaaaatattagttgcaacagatattcatcttggatttatggagaaagatgcagtcagaggaaatgatacgtttgtaacactcgatgaaattttaagacttgcccaggaaaatgaagtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtttccatgggtgaactatcaagatggcaacctcaacatttcaattccagtgtttagtattcatggcaatcatgacgatcccacaggggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggatccattccagatgaaaggctctatcgaatgtttgtcaataaaaaagtaacaatgttgagaccaaaggaagatgagaactcttggtttaacttatttgtgattcatcagaacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaaacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaagattgaagaaatgcttgaaaatgctgaacgggaacgtctgggtaattctcaccagccagagaagcctcttgtacgactgcgagtggactatagtggaggttttgaacctttcagtgttcttcgctttagccagaaatttgtggatcgggtagctaatccaaaagacattatccattttttcaggcatagagaacaaaaggaaaaaacaggagaagagatcaactttgggaaacttatcacaaagccttcagaaggaacaactttaagggtagaagatcttgtaaaacagtactttcaaaccgcagagaagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtacgtcgtttcagagaaaccagacaaaaaaatactaatgaagaagatgatgaagtccgtgaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagagcagacactggtctggagacttctacccgtagcaggaactcaaagactgctgtgtcagcatctagaaatatgtctattatagatgcctttaaatctacaagacagcagccttcccgaaatgtcactactaagaattattcagaggtgattgaggtagatgaatcagatgtggaagaagacatttttcctaccacttcaaagacagatcaaaggtggtccagcacatcatccagcaaaatcatgtcccagagtcaagtatcgaaaggggttgattttgaatcaagtgaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctct

SEQ ID NO: 292754 - DNA, 1236 bp, Homo sapiens
atgggtatgacctgggtcttattcacactgcattttggggttcctgagctgcttgtttgagcgagaggtgcttcaggttcaggtcttatgcctagccccttgggtgagagggcctattctgattggcccccaggccctgctgtggagtctgggtctgagttgaactgctgagaaagagccccagacctccagcatcgtggtggagcactggagatgctctggagccagcctgcctggggtcaagtccgggttccatctctgactgtgtgacctcggggacgtgccataactgctctgtgcctcggtctcctcatcggtgaagtatttccctcttagggatgttgtgggaatgaagtgggtgaaggaatgcgagtcctgagaaccgtgtctgctttgtgcacgtgctcagacgcatcaacgattctgcttctcattcgcttctggtgccttttaagtgctgccagggtgtccgcactgtgaacggtccttgacggggtgttatcttcagaaagggaagactagcacccggccccccaggcttccaaagcatcatccatgcaaccatgttggctttcaattccttggagttaaggctgacggccatctggttctaacccggcctcctgtcttcctgtcccactgacttcccgttcttcagctgctctaggcttccctgtctgtctccagaccctagcccacctctgttcccttcccaggctcagctcatccatcaccaactgccatggacccctcttcagcaccctgccccctcctgcagtccctccgcccagccagtacctggtttctgtctcagcggggagctgactcctctctgtgccccccagcgcagggctggactctgaggaggaggactcagtagataggtattgagtgatgagatgagggaatcggctttctgtggccgggaacactcctgctgcagggggtccacctgatgggtgagtcagagaaagactcaggcctgttgaaagtggatcaacaggcaggcagggagatggccagtagccagccgtccgtcctgttcacagcctgcggagtggtgaggctgcctctgtgttttcatggatctgagattcagaacatagctggtttacagccatggcccagttgtgtgctctggagtttcactgcctgaattttaacttgaaaatgtaggacttgggagtctctctgagccattctggcttgggagattgcctgattatatatttcaaa

SEQ ID NO: 292755 - DNA, 1110 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcaggtgaacggcgtgggaggggcgcgcgggcccggggggtgcgagaaagcctctgtcatcgccccggagccccgaaccgcggccgcttcccccgatcctcccctcacccgcgccccttccctgcccctgccctggccccggccccgcgacgccctcgcagagcagacctgatctccgggttcggtggttcctggaccttgcacagtctccaaatcagtccgcggctgacccggagactgaaccccaaccagcccgtgagcgaggacggctgagtccgcagtgtgcgccaccagggtggtccccagagtgtccttaagtcggttctcctcggtggggctccaaggccgacgggaattagccgggatagaaaggcggggcacaggggcctgggggggttagaatgtgcgcgcagcggggggcgcagtctgtgcgcgcttggcagtggcaggagtccttcccggagcacaggaggcacgaggggagcgtagatgagaggggagcggcctcccccgccccagggcgggaacctttgggtacatagcgggttctagaatgcggagggggctgggtttc

SEQ ID NO: 292756 - DNA, 3414 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292757 - DNA, 3585 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagtgagtagggaaggagcttcagggggagcaggagacccctgcttcaggcctgccctgagtcccggctctggccctgcaggcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292758 - DNA, 1594 bp, Homo sapiens
gggctttttcgagcccataggtcgggacagcccaggactgggcatgggaggcttggagtggctctgggtaggggcccagccagtgccctaggggacttcatataccctctcttcctttgcaggaaaccccctcggcttcaggacttccgctgcttagctgtgctgggccggggacactttgggaaggtagtgggctgaagagggtggtatgggacaggattgggggcctcatcacatgagccgggaggacctgatctgtgggggcggtaaaggctccctggtctggccgcacctggagcacaacctctctctggccccaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292759 - DNA, 2199 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292760 - DNA, 1779 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccagagtgtgtgtctgggggtaccgggctcg

SEQ ID NO: 292761 - DNA, 1075 bp, Homo sapiens
aagtagaggctgggtgtaaaatcggacgaggaaggctggctgtgcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292762 - DNA, 715 bp, Homo sapiens
ctcctccagaagtgcccggagaagcgcctcggggcaggtgagcaggatgccgaggagatcaaggtccagccattcttcagggtgagcggctggggtggcggtggtcccctgtgcctggcagggtaggtggcatggagtgactcctggagctgctgttcctgccgtctcaggcgcctctcctttgccctcagaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtga

SEQ ID NO: 292763 - DNA, 3506 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292764 - DNA, 3640 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtagtgggctgaagagggtggtatgggacaggattgggggcctcatcacatgagccgggaggacctgatctgtgggggcggtaaaggctccctggtctggccgcacctggagcacaacctctctctggccccaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292765 - DNA, 3088 bp, Homo sapiens
ggagccaggttgtagaggggctcaaagttagaggaggcggccagctccaccggctgcacccggctgggcgacccggcaaccttcagggggcgctgtttcccccatccctgtccccaactggccggctcccgcgggcgcgcggcggggaaggccagaggacctgggcgcgggcgatgtgcctcctgagcgtccaaaccgggggtgaggcgcggtcacgcccagcgggaaccgcaggcgccgaagcccgggtactgggcccagaatcccgcggaattttggatccgagggaggcgctggggcgcgggacctcgggcgtggggtcccgggcgctggatcggcgcggacgggaggcggcgctggtcccgcgggccagcgggtctcgggagggggcgcccgatcccgcgtctccggcgccgcttcccgggaagtttcaagtttgaaagtcctggcggagggtctgcggcttccgggaccggagtggctgagaggagggccccaagcggccggagcggcgccatggaggagggggcgccgcggcagcctgggccgagccagtggcccccagaggatgagaaggaggtgatccgccgggccatccagaaagagctgaagatcaaggagggggtggagaacctgcggcgcgtggccacagaccgccgccacttgggccatgtgcagcagctgctgcggtcctccaaccgccgcctggagcagctgcatggcgagctgcgggagctgcacgcccgaatcctgctgcccggccctgggcctggcccagctgagcctgtggcctcaggaccccggccgtgggcagagcagctcagggctcggcacctagaggctctccggaggcagctgcatgtggagctgaaggtgaagcagggggctgagaacatgacccacacgtgcgccagtggcacccccaaggagaggaagctcctggcagctgcccagcagatgctgcgggacagccagctgaaggtggccctgctgcggatgaagatcagcagcctggaggccagtgggtccccggagccagggcctgagctgctggcggaggagctacagcatcgactgcacgttgaggcagctgtggctgagggcgccaagaacgtggtgaaactgcttagtagccggagaacacaggaccgcaaggcactggctgaggcccaggcccagctacaggagtcctctcagaaactggacctcctgcgcctggccttggagcagctgctggagcaactgcctcctgcccaccctttgcgcagcagagtgacccgagagttgcgggctgcggtgcctggatacccccagccttcagggacacctgtgaagcccaccgccctaacagggacactgcaggtccgcctcctgggctgtgaacagttgctgacagccgtgcctgggcgctccccagcggccgcactggccagcagcccctccgagggctggcttcggaccaaggccaagcaccagcgtggccgaggcgagcttgccagcgaggtgctggctgtgctaaaggtggacaaccgtgttgtggggcagacgggctgggggcaggtggccgaacagtcctgggaccagacctttgtcatcccactggagcgagcccgtgagctggagattggggtacactggcgggactggcggcagctatgtggcgtggccttcctgagacttgaggacttcctggacaatgcctgtcaccaactgtccctcagcctggtaccgcagggactgctttttgcccaggtgaccttctgcgatcctgtcattgagaggcggccccggctgcagaggcaggaacgcatcttctctaaacgcagaggccaggacttcctgagggcttcgcagatgaacctcggcatggcggcctgggggcgcctcgtcatgaacctgctgcccccctgcagctccccgagcacaatcagcccccctaaaggatgccctcggaccccaacaacactgcgagaggcctctgaccctgccactcccagtaatttcctgcccaagaagacccccttgggtgaagagatgacacccccacccaagcccccacgcctctacctcccccaggagccaacatccgaggagactccgcgcaccaaacgtccccatatggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292766 - DNA, 1418 bp, Homo sapiens
ggctagtagagctgggttcgaatcggccgaggggagcctaggactcgacgtgggccatctccaccagcctcccccaccaggaaaccccctcggcttcaggacttccgctgcttagctgtgctgggccggggacactttgggaaggtcctcctggtccagttcaaggggacagggaaatactacgccatcaaagcactgaagaagcaggaggtgctcagccgggacgagatagagagcctgtactgcgagaagcggatcctggaggctgtgggctgcacagggcaccctttcctgctctccctccttgcctgcttccagacctccagccatgcctgctttgtgactgagtttgtgcctggtggtgacctcatgatgcagatccacgaggatgtcttccccgagccccaggcccgcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292767 - DNA, 1028 bp, Homo sapiens
ttctcccataaccacccctgcagcttctacgtggcttgtgttgtcctggggctgcagttcttacacgagaagaagatcatttacagggacctgaagttggataaccttctgctggatgcccagggattcctgaagatcgcagactttggactctgcaaggaagggatcggcttcggggaccggactagcaccttctgtggcaccccggagttcctggctcccgaggtgctgacccaggaggcatacacacgggctgtggactggtgggggctgggtgtgctgctctacgagatgctggtgggtgagtgcccgttcccaggggacacagaggaagaggtgtttgactgcatcgtcaacatggacgccccctaccccggctttctgtcggtgcaagggcttgagttcattcagaagctcctccagaagtgcccggagaagcgcctcggggcaggtgagcaggatgccgaggagatcaaggtccagccattcttcaggaccaccaactggcaagccctgctcgcccgcaccatccagccccccttcgtgcctaccctgtgtggccctgcggacctgcgctactttgagggcgagttcacagggctgccgcctgccctgaccccacctgcaccccacagcctcctcactgcccgccaacaggccgccttccgggacttcgactttgtgtcagagcgattcctggaaccctgagggcatctcctggcacctctgtccccttcccccacagactgttagagcctctgctcgttcacccgtgcgccctgcctggaggtccaggccttgctgggtacttctgagcccttgggattcaaagtggcagccatggggccactgttgtgggctttgctcagtgtcactgggcaaagtgtgtcccttccccctccagctcgccctcttctacctcccagcgagacctggcccagaaagggtgccgcagcaaggagtgatatggtttgtctttttaagactggacttgctttatattaaatttgtaaaagtgaaaaaaaaaa

SEQ ID NO: 292768 - DNA, 1006 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagaatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292769 - DNA, 960 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292770 - DNA, 839 bp, Homo sapiens
gactccagccgcacctcctccggctctgcagtggcggcgaggaggcgagccggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292771 - DNA, 871 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagagaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292772 - DNA, 1577 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggtaccgggctccctccggagccaggggaggggaggggtcccggggcggagcccggagggcgggggtctgattcggaggtggcgtggagggtgctgaagggtcggggggctggatggggaaggcaggcggagacgccggacgggattcttgggggtctaggagaccatcctccgccatcctcttccgcgctcacctaggggaatgtaggcggcagctcggaggcgggggtctgcggcccggaggcgggggtctgcggcccgccaccgccccgggcttctcctgtcgcggctgcagtcgttcggttatccgctgctgctgataccccagcctgggtttcggcttcgctttccctgccctactcggcgagctctggaaagcaggacctgctctcggatacccgctgctcggggacctcctcctagcgcgtcccccgccgggcctcccctcggtcgcttccctgcgggccgggctgtgagcggctgtggggacagacccaggctggggaagggggaagcgctcccttgcccgcttccggatctcgctttatcctgccgccgctttcagactccctggccaccctgtccactcccatggcctccacattgaagcttctaagcccagccctgcgacctacggccgaacctctccctggacgtcccagggtgctccctggtcagcaagtccaaaacagaactctcgcttcccaccttctctcctaagtgatcctctttatcccccttccgtgtctcactttcccaagtccttgtattactgggtctgggtgtgcaaggaatagccatttctttatttcttgaaatttaattaataccaaagcccccattgtctgcagggtttgatgggcaaacttcatatcagatattattaatatgaacagctcccctccccaggaaattggataacttcttggctccaggccatcttccttgtccaatcccagccactacttcagatatcccctggagtacaggcttctttgcccacgcaggaaacattgctgctgggtcccagaaagcatctccctgaggccttttcatccctcagcagcccctgagctaatctccccatcttcagtctctcctccctgctttcaatctcgtccccaatctcatattcactccctttctatatcatagcctgaagactcttcttaaaatgcagtggctcacgcctgtaatcccagcactttgggaggctgaggcgggcggatcacaaggtcaggagttcgagaccagcctgaccaacatgttgaaaccccgtctctactaaaaatacaaaaattagctgggcatggtggtacgcacctgtaatcccagctactcgggaggctggggcaggagaatcacttgaccctgggagccagaggttgcagtgagctgagattgt

SEQ ID NO: 292773 - DNA, 1163 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacagccagtctagtgggaatgataaaggaggcttggaaggccaactctttccctcttctaccagcaagggccatccatggtgccagcttctaggcgaggtagagtgagttcttcaggactgctggcaggaagatcatgagcaggtgtttgttccaagggaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagaatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292774 - DNA, 1095 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacagccagtctagtgggaatgataaaggaggcttggaaggccaactctttccctcttctaccagcaagggccatccatggtgccagcttctaggaatgctccaaaatgggaagaagtttgattcatccagagacagaaacaaacctttcaagttcagaattggcaaacaggaagtcatcaaaggttttgaagagggtgcagcccagctgggtcctctttctcctctccccatctgcccccatccctgctagaatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292775 - DNA, 1028 bp, Homo sapiens
gactccagccgcacctcctccggctctgcagtggcggcgaggaggcgagccggagcgacggcggggctggggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggcgaggtagagtgagttcttcaggactgctggcaggaagatcatgagcaggtgtttgttccaagggaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacaaaaaaaaaac

SEQ ID NO: 292776 - DNA, 1026 bp, Homo sapiens
tgtttggaacctgggattcaaatggcctggcaggaagtgctctagcagagggactctggccttgcaagagtccctatttccccctttttttttgcttttcacacagtaaaaccctgctttacttccctttgagtcgtctgtgagcctaaatttttgtggctgtgggaaggacaagaaccccatctttagctgaaataaggaaaagttccgcaacatttttggcacacaccctgggggctccggaagtggattatgttggctcggagaatgatacctcaaaggctggtgctgagagttcttagaagctgcttcagaatcaaggatctctccagagatcaaccactggagaaaagatactaggagtcatcaccacatctagacagagtgctgctccaagagattaactgagggatttcatctgcataataagtcaaccttttttccaggcgcaatggctcacgcctgtaatcctagcactttcggaggcccagttgtcttctcctcatagtcctccactaaagcctgaacaacaaggaatgctgtcggaactggaccttgatgaaggaaatactttctgactcattggaatttgttatagtcaaaaaccctcaaccctgcatcctaccatcctgggcttgcactgcaagttacatgatccctgagctgaccactttggcttgaatccctggaaggagaaaggagagagagagcaactagttcagacacaagcatctagttcagctttggtactgcttaattctgtttttctccctccctctaatcctttttttgactgtcacatttgtcctaatagcaagttaggacatgtctgttggctctcgagattcatgggacagcaatgcagcaaatctagccatagtatttgctctctctagccctgccctttttcctgtccagtgaatatcaaaacaggtagaaaacatggcctgaaggattgtctctgccaccacctccatatgcattttaccagtagtcctgtcatacaggttgaattagttttatgta

SEQ ID NO: 292777 - DNA, 430 bp, Homo sapiens
cagtacctatctgtcgcctgggggttggggacccttgctttaaatgttacagcttttaatgaccatcctagaggttgaacttctggtccccttaaacaggtcttggaatgtcttcctcttgggttgaatttgaaaatcctctgctattacaagaggtctaagactcctaatagctctttcagacctgactctcacctttaattttactccccagttgtcttctcctcatagtcctccactaaagcctgaacaacaaggtaggaccattcgttttatttccccttttgtcctggctcatctttctttattgctgatgtgttattctttgcaggtagacagttgtttcctccccctgctatctgttctgagtcagggagaaacgtcaacttgggtgacgactaagttagtggtcattgcaaagttctttagg

SEQ ID NO: 292778 - DNA, 1575 bp, Homo sapiens
caatgtaggaaaggtgatttctaatggatgccacacgttgtagatctctgacctctattttctcgctggtggtacatctactgcacttacacatatgttgttccttttcatttccagaagattcacttagttccttgatacagaatcagagcttaagactgtcatttcacaagagcattgagcacaatgaaactgtgaatctttgaagcttatgattatgcttcacatttttgtaaacttcaaataaccttggaaaaatttccagattgggtgtagagttatttaattataaagaactattttaggtatagtcaatgattttcaattattatgtcaattacattcgttgtattcacttacggactttatggtaggttacaaaaatatatactttgaaaagaaatatactctttatgcaaaggaagctatgccatcaacaaacttgacctctaattcccaagtttattacagaaaaatttgtagtgtgaaaaaggcaaacatctccagctcatcttctcaggtatctatgaagattccgtacaaactcctttcaaatttttcccaggaatgctgtcggaactggaccttgatgaaggaaatactttctgactcattggaatttgttatagtcaaagtaagtaaggcacaaatattgaagataaacttggtacagtatgtagtgccttttgttattaaatgcaactttgggtgattacttgacattttgacttcattgatttactaaaagaagttttgaaaattttactgaagaccactgtttttgtttttgctattgtttttaaatttactatatatgatgtttgtagtcatttctatgaaaatgttggcattaagccttttaatgaggggcacaatctgctaccataatattcttttaatgggaaatcaagtaggaatggataattgtgacttttctaggaatggagaccactgaaaatgagacagaaactagtgtgtataaatacattacagtatgggtgtggatgttcacactccacaccatgaatgcaatgaaaggatctctaatcactgtagatagtgctttgcatgttatgtttccagtctgggtatagctggcatcttattaacaaaaggaattcatcacttctgtttggaatcattctctatcagaaccctcaaccctgcatcctaccatcctgggcttgcactgcaagttacatgatccctgagctgaccactttggcttgaatccctggaaggagaaaggagagagagagcaactagttcagacacaagcatctagttcagctttggtactgcttaattctgtttttctccctccctctaatcctttttttgactgtcacatttgtcctaatagcaagttaggacatgtctgttggctctcgagattcatgggacagcaatgcagcaaatctagccatagtatttgctctctctagccctgccctttttcctgtccagtgaatatcaaaacaggtagaaaacatggcctgaaggattgtctctgccaccacctccatatgcattttaccagtagtcctgtcatacaggttgaattagttttatgta

SEQ ID NO: 292779 - DNA, 641 bp, Homo sapiens
tgtttggaacctgggattcaaatggcctggcaggaagtgctctagcagagggactctggccttgcaagagtccctatttccccctttttttttgcttttcacacagtaaaaccctgctttacttccctttgagtcgtctgtgagcctaaatttttgtggctgtgggaaggacaagaaccccatctttagctgaaataaggaaaagttccgcaacatttttggcacacaccctgggggctccggaagtggattatgttggctcggagaatgatacctcaaaggctggtgctgagagttcttagaagctgcttcagaatcaaggatctctccagagatcaaccactggagaaaagatactaggagtcatcaccacatctagacagagtgctgctccaagagattaactgagggatttcatctgcataataagtcaaccttttttccaggcgcaatggctcacgcctgtaatcctagcactttcggaggcccagttgattttcagcacatcttcagaggacaaagaagcagctcttttcactcctacaatgggaatgataatctccaccttatttagttttaaaagaattaaatgagataatgcagctaaagcagttcagaataaaacctgacatgtagtaata

SEQ ID NO: 292780 - DNA, 913 bp, Homo sapiens
ccggaagctcccacctgagcaggcgcatcctcagggcctgggcctggcctccttgcctgtgagatggcactgtgacggtgcccacctcgtggggtgtgtgagggccgagtgaaatcgtgcatttgcgctaacgatgagaaccactgcttgagggccttcctatttcttccaccatgcatctggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactcatggctgagactgaggggagccttttacagcagctctgaaagcaggaggtgttctcagacttgaccctgaagtaaacacatctctttcacctttt

SEQ ID NO: 292781 - DNA, 858 bp, Homo sapiens
ccggaagctcccacctgagcaggcgcatcctcagggcctgggcctggcctccttgcctgtgagatggcactgtgacggtgcccacctcgtggggtgtgtgagggccgagtgaaatcgtgcatttgcggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactcatggctgagactgaggggagccttttacagcagctctgaaagcaggaggtgttctcagacttgaccctgaagtaaacacatctctttcacctttt

SEQ ID NO: 292782 - DNA, 306 bp, Homo sapiens
ccggaagctcccacctgagcaggcgcatcctcagggcctgggcctggcctccttgcctgtgagatggcactgtgacggtgcccacctcgtggggtgtgtgagggccgagtgaaatcgtgcatttgcggagaagaaaggaaggagagctgagtgtggtgaaaaaagtgaagagtgctggctttggaagcatgtatgctaaaattggaaccacacagagatgaccatgacccctgtgcaaggatgctgtgcaaattcatgaagcattccgtatttttataagtaaataaatggaaaaaagtgtaaaga

SEQ ID NO: 292783 - DNA, 1126 bp, Homo sapiens
ccggaagctcccacctgagcaggcgcatcctcagggcctgggcctggcctccttgcctgtgagatggcactgtgacggtgcccacctcgtggggtgtgtgagggccgagtgaaatcgtgcatttgcgatgtctaggacacactggatttgtacatctggggctcaggagaggaccagatcagagctggaaatcatgccaggaagagtatgaagcatggagagaaggtgtggaggcctccctgaggaaacgaggggtcgagcaggtgaagagggggctgagagctaaggagtgcacagagacaatgacagaaagacgggaggtctggtttcaggaagggtgtgatggacagaagagatgcagcagaggtcaaggaaggaccaagatgcatcaggaggaaatgcccatgaccttcatcgcagcagcgtatgtgcgttggtcttctccagggatgccgaaagtagacatacagggagtcgcagtacggataccaccagtgccagcctgacctcacaagagacgtcttgtgtgactggccctgccgtcacagctgggccagtaaagtaccttccaggaggctccagttgctacctgactcacaaccttctaatcccatgatcttttagttctagtttccttatcttggtctgagcaaatggctcattttaaagatgacttgcagacaaatgtagagatcatcccaggggaaagtgccccaagaaaggagagtccaagaccacctgcccctcccagttctgcggctggagtgggtgggtgcagcaaccacagccccagtgtacaggagtcaccactgtctcctcccgcattggcccagcttggaagtgcacagcaaccaagcatgaggactgagttaagcttttcggagaaaaaagacactatgatcatctggcagatcacgatcactgtttggtgccagaggtaaggagtttgcttgttgtgtttgcttggaggcgacagttggcaatgacagcctgggagaagcaccggcagttaacagcactctgcaccactcatggctgagactgaggggagccttttacagcagctctgaaagcaggaggtgttctcagacttgaccctgaagtaaacacatctctttcacctttt

SEQ ID NO: 292784 - DNA, 282 bp, Homo sapiens
ttagagaattttcatgataaaagtttaaaagtacatacacacacacaaaacaatacccatgttgcaagaacacattgaaataagaagataaacattaaaatggttggttaccttttaggagaagaaaggaaggagagctgagtgtggtgaaaaaagtgaagagtgctggctttggaagcatgtatgctaaaattggaaccacacagagatgaccatgacccctgtgcaaggatgctgtgcaaattcatgaagcattccgtatttttataagtaaataaatgg

SEQ ID NO: 292785 - DNA, 1032 bp, Homo sapiens
  misc_feature (42)..(42): n is a, c, g, or t
  misc_feature (1029)..(1029): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaaaaaactcgagggnggg

SEQ ID NO: 292786 - DNA, 929 bp, Homo sapiens
ggagtagtgcctattttagacctgcttggaagaatataactcaatgcagtgtcttacttttgctgctgagcggtttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcatggggcttcgccgccccatttgcaaaaagatccccgaatcgcaaacaaccttggtagacacaacaaataaaaa

SEQ ID NO: 292787 - DNA, 578 bp, Homo sapiens
  misc_feature (7)..(7): n is a, c, g, or t
actggcngactctagtaggatcccctgatttggatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292788 - DNA, 970 bp, Homo sapiens
  misc_feature (861)..(861): n is a, c, g, or t
  misc_feature (923)..(923): n is a, c, g, or t
  misc_feature (928)..(928): n is a, c, g, or t
  misc_feature (933)..(933): n is a, c, g, or t
  misc_feature (970)..(970): n is a, c, g, or t
ggagtagtgcctattttagacctgcttggaagaatataactcaatgcagtgtcttacttttgctgctgagcggtttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatccgataaaatggtattactacagctttcccaaatgggttacgnggacaattttagaaagatcgcgattggaacaaattgggataaaaaaaaaagtggcggggaanaaagnggggnaaagaggaagggggaaagagggggatgaagagtcagn

SEQ ID NO: 292789 - DNA, 498 bp, Homo sapiens
ggacgcgtgggtgacccacgcgtgcgcttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292790 - DNA, 312 bp, Homo sapiens
aatacccgggtcgactactacaactaaattcccgcccgcgtcgactgagttttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292791 - DNA, 898 bp, Homo sapiens
gtaaaaatctcattttacatctgagaaaaccaaagtcagggatgaagtgaaatgcctgaaataaaatagcttcttaaaactgggcctcaagcttccagtattctttccactgtaccactttattgatgtgtatgatgtagtgttgattttagcctggcaggtaaatgttacttgtttgtagaataagatgtgaccattcatgccacttgaaggaaccgtaaggcttagattctttaaccatactttttattactttgtttaggcataggtttagtctctcttatcaagagatcagaagctgaatgtggaggcagaatgatagagcaaatgatagagcggagcagtgctgctaagcagctaggcatttttctaggcacttctctgctgaggctgttttaagtaggtggacaccctgtagttcatatatttgcatgtttatagtttgtaacatacagaacatgcttagtcaagtatagatattctttgtaattaaccctcagaatagtatgtattctgatcccttgttctttattctccaggcaccatacaggaagattacttgagagagctgctgacaaccatgggggatcggtttacagatgaggaagtggatgagctgtacagagaagcacctaattgtttaaacttcttatttaccaaacttggcttttgttggtttcagtcgtatctcccaaagaaaggtagatgagggaaatacctagaaaatgatatggttgttagctttctcttcctccagttttcctaacaatcctatctcctctactatccattcctcctcctcctcccaaggatatccaattttaactgccctaatcaggttttctgcactttgtcttccaatttttaaaataatttcctgtagaatttgcatatatga

SEQ ID NO: 292792 - DNA, 999 bp, Homo sapiens
  misc_feature (8)..(9): n is a, c, g, or t
  misc_feature (21)..(21): n is a, c, g, or t
catcgacnncccttttctcgngaagcgcgccattgtgttgttacccgcgaattcggccattatggccggggggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292793 - DNA, 949 bp, Homo sapiens
ggcacgagttttttttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292794 - DNA, 1047 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaaaatcactgcccgtcgttttaccgtcgtgctg

SEQ ID NO: 292795 - DNA, 1273 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataattgtttaaacttcttatttaccaaacttggcttttgttggtttcagtcgtatctcccaaagaaaggtagatgagggaaatacctagaaaatgatatggttgttagctttctcttcctccagttttcctaacaatcctatctcctctactatccattcctcctcctcctcccaaggatatccaattttaactgccctaatcaggttttctgcactttgtcttccaatttttaaaataatttcctgtagaatttgcatatatga

SEQ ID NO: 292796 - DNA, 960 bp, Homo sapiens
ggagtagtgcctattttagacctgcttggaagaatataactcaatgcagtgtcttacttttgctgctgagcggtttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292797 - DNA, 933 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagccaccaactaccccactcccgtaccaggg

SEQ ID NO: 292798 - DNA, 935 bp, Homo sapiens
aagcagtggtatcaacgcagagtgccattacggccgggggctgagcggtttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292799 - DNA, 957 bp, Homo sapiens
aacgagtcggttcactagtacggtcgcagttgtgctggaacttcggcttacgggtgaggtacagctacgagaatccgagcacctctccgagcccctcgctgccgctatgacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292800 - DNA, 956 bp, Homo sapiens
ccgcccttcgccgtgccctggaatgtgcggccaggcaaagccacaggacggacgcaaccatctgcggaaaggataggggggaggaagacttaacactgcaacaacaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292801 - DNA, 928 bp, Homo sapiens
aacgagtcggttcactagtacggtcgcagttgtgctggaacttcggcttacgggtgaggtacagctacgagaatccgaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292802 - DNA, 1108 bp, Homo sapiens
ctaatttcttttcatttatatttttttttgtagagatggggtcttgctatgttgcccaggctggaatgcagtggcgtaaccttggttcactacagcctcgacctcctaggcccaaacgatcctcccatctcagcctctccagtggttgggactataggcatgcgccactacgcctggctaattttatttttcatagagatgaggtctcactgttgcccaggctggtagagactaggggtgtggactcaggtggtgtatagacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292803 - DNA, 1117 bp, Homo sapiens
ggagtagtgcctattttagacctgcttggaagaatataactcaatgcagtgtcttacttttgctgctgagcggtttgcagactaccatcttccctgcaactctgaaggatggtatggtagaattttattgtctgatgactgagatttttaacttgaaacaaatttttgtagtttttaacagattgagtattgaaaattgcctttttattttaggtattattagacattctttttaattttaacttaaattttaccgggataaatttaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292804 - DNA, 1035 bp, Homo sapiens
atgatctcggctcactgcaacctccatctcctgggttcaagcgaatctcctgcctcagcctcttgagtagctggaattactcctgacctcaagtgatccgcccacctcacgcctgtaattccagcactttgggaggccgaggcaggtggatcacgaagtcaggagttcaagaccagcctgcacaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292805 - DNA, 984 bp, Homo sapiens
aacgagtcggttcactagtacggtcgcagttgtgctggaacttcggcttacgggtgaggtacagctacgagaatccgagcacctctccgagcccctcgctgccgctatcacaccaccctgctacccagagagccggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292806 - DNA, 943 bp, Homo sapiens
aaaagaacggctgatgagtctgaaagattgtcgatgggtgcttcttgttctagaagctgcgccgggacttaacgagggttatgtctagctgatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292807 - DNA, 963 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292808 - DNA, 857 bp, Homo sapiens
aacgagtcggttcactagtacggtcgcagttgtgctggaacttcggcttacgggtgaggtacagctacgagaatccgagcaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292809 - DNA, 573 bp, Homo sapiens
tactgtgcagctcggtaccctgatttggatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292810 - DNA, 647 bp, Homo sapiens
  misc_feature (39)..(39): n is a, c, g, or t
agctggacccgtcaccttctatcagaaagtaaacctcgntcagaagtctggtttcctgctctctccctcatgcacatcttcagaatccaaatcatgatttggatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292811 - DNA, 891 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcgatactgagatcttcgcctggttcggcgccatcttcagaatccaaacagggtacg

SEQ ID NO: 292812 - DNA, 847 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagaatcggtcaccctgaagtttatattcttatcctaccaggcttcggaataatctcccatatagtaacttactaatccggaaaaaaagaacatttggatcata

SEQ ID NO: 292813 - DNA, 947 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctaacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292814 - DNA, 1287 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctaacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaaaaaaaaaaaaaaaaaattttccgtgcgaccgcaatctgagttgactagtccaatctatcctatagtgagtcacattacactgcactggcctttacatcacaacgactggaatgacaatgccgtgacctactcaactgaattgccttgcatcccattctcgtctggtgaggtgatgtaatagagaacaggcccgaccgatctcccttccaacagtagcctaactgaaagcggatgtaaatcggagctttatgttagttaaagtcaagttatttttagtaatcatttatttctagcgactggccgagtgcccctccttttaatgaaagactgccgg

SEQ ID NO: 292815 - DNA, 1025 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatctctggttttgctggatttttacatttttatatcataaacatgtcattttgaacacaccccaactccccct

SEQ ID NO: 292816 - DNA, 1030 bp, Homo sapiens
gtaaaaatctcattttacatctgagaaaaccaaagtcagggatgaagtgaaatgcctgaaataaaatagcttcttaaaactgggcctcaagcttccagtattctttccactgtaccactttattgatgtgtatgatgtagtgttgattttagcctggcaggtaaatgttacttgtttgtagaataagatgtgaccattcatgccacttgaaggaaccgtaaggcttagattctttaaccatactttttattactttgtttaggcataggtttagtctctcttatcaagagatcagaagctgaatgtggaggcagaatgatagagcaaatgatagagcggagcagtgctgctaagcagctaggcatttttctaggcacttctctgctgaggctgttttaagtaggtggacaccctgtagttcatatatttgcatgtttatagtttgtaacatacagaacatgcttagtcaagtatagatattctttgtaattaaccctcagaatagtatgtattctgatcccttgttctttattctccaggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292817 - DNA, 664 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctactacccgtaagccgattccacaactgcgccgtactagttcacgagctgg

SEQ ID NO: 292818 - DNA, 1085 bp, Homo sapiens
  misc_feature (1057)..(1057): n is a, c, g, or t
  misc_feature (1059)..(1059): n is a, c, g, or t
  misc_feature (1074)..(1074): n is a, c, g, or t
  misc_feature (1082)..(1082): n is a, c, g, or t
gtaaaaatctcattttacatctgagaaaaccaaagtcagggatgaagtgaaatgcctgaaataaaatagcttcttaaaactgggcctcaagcttccagtattctttccactgtaccactttattgatgtgtatgatgtagtgttgattttagcctggcaggtaaatgttacttgtttgtagaataagatgtgaccattcatgccacttgaaggaaccgtaaggcttagattctttaaccatactttttattactttgtttaggcataggtttagtctctcttatcaagagatcagaagctgaatgtggaggcagaatgatagagcaaatgatagagcggagcagtgctgctaagcagctaggcatttttctaggcacttctctgctgaggctgttttaagtaggtggacaccctgtagttcatatatttgcatgtttatagtttgtaacatacagaacatgcttagtcaagtatagatattctttgtaattaaccctcagaatagtatgtattctgatcccttgttctttattctccaggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaaaaaaaaaaaaaaaaaaaaaananaaaaaaaaaaaaaanagaaaacnaca

SEQ ID NO: 292819 - DNA, 586 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacagtatgatactcggcgtgtggtccggcctg

SEQ ID NO: 292820 - DNA, 972 bp, Homo sapiens
atgatctcggctcactgcaacctccatctcctgggttcaagcgaatctcctgcctcagcctcttgagtagctggaattactcctgacctcaagtgatccgcccacctcacgcctgtaattccagcactttgggaggccgaggcaggtggatcacgaagtcaggagttcaagaccagcctgcacaaggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctaacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292821 - DNA, 693 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactgtttccattcaggtagatttcttgagagagctgttgtcaaccttgtgggattgttttttatttgtttattttaattagccttacgtcttttttttttttgttattatcttttatttattttctgttgtctcataccctccctcatcattggcaccacccccgcgggtctttttttttcttttttttcttgtactctttctttttctctcttttctttttatt

SEQ ID NO: 292822 - DNA, 1010 bp, Homo sapiens
  misc_feature (42)..(42): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaata

SEQ ID NO: 292823 - DNA, 999 bp, Homo sapiens
  misc_feature (42)..(42): n is a, c, g, or t
  misc_feature (906)..(907): n is a, c, g, or t
  misc_feature (910)..(910): n is a, c, g, or t
  misc_feature (914)..(916): n is a, c, g, or t
  misc_feature (918)..(919): n is a, c, g, or t
  misc_feature (935)..(935): n is a, c, g, or t
  misc_feature (945)..(945): n is a, c, g, or t
  misc_feature (949)..(949): n is a, c, g, or t
  misc_feature (951)..(951): n is a, c, g, or t
  misc_feature (968)..(969): n is a, c, g, or t
  misc_feature (971)..(972): n is a, c, g, or t
  misc_feature (979)..(979): n is a, c, g, or t
  misc_feature (984)..(984): n is a, c, g, or t
  misc_feature (988)..(988): n is a, c, g, or t
  misc_feature (993)..(993): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcnntanaagnnntnnaaaaaataaatgtggntttaaagggnaatntntttttaagggaagtttnngnngtttttntggtnatantaaanttttgt

SEQ ID NO: 292824 - DNA, 613 bp, Homo sapiens
  misc_feature (7)..(7): n is a, c, g, or t
  misc_feature (585)..(585): n is a, c, g, or t
  misc_feature (587)..(587): n is a, c, g, or t
  misc_feature (602)..(602): n is a, c, g, or t
  misc_feature (610)..(610): n is a, c, g, or t
actggcngactctagtaggatcccctgatttggatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaananaaaaaaaaaaaaaanagaaaacnaca

SEQ ID NO: 292825 - DNA, 874 bp, Homo sapiens
  misc_feature (774)..(774): n is a, c, g, or t
ggagtagtgcctattttagacctgcttggaagaatataactcaatgcagtgtcttacttttgctgctgagcggtttgcagactaccatcttccctgcaactctgaaggatggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagttaaagttggattcctgtggattatctccagcatgggtatgttttttacaacggangggtttatattgaaaaaggattttctaaaaaaaaaatggggggcaaataaaaagggggggaagaagagtaaaggagtgtaaaggggaaggttagaaaaag

SEQ ID NO: 292826 - DNA, 1065 bp, Homo sapiens
  misc_feature (42)..(42): n is a, c, g, or t
  misc_feature (1037)..(1037): n is a, c, g, or t
  misc_feature (1039)..(1039): n is a, c, g, or t
  misc_feature (1054)..(1054): n is a, c, g, or t
  misc_feature (1062)..(1062): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaaaaaaaaaaaaaaaaaaaaaananaaaaaaaaaaaaaanagaaaacnaca

SEQ ID NO: 292827 - DNA, 1045 bp, Homo sapiens
  misc_feature (42)..(42): n is a, c, g, or t
  misc_feature (1017)..(1017): n is a, c, g, or t
  misc_feature (1019)..(1019): n is a, c, g, or t
  misc_feature (1034)..(1034): n is a, c, g, or t
  misc_feature (1042)..(1042): n is a, c, g, or t
gagacccactctgcgggccaagaaaggtgaccgggcttcctnccggcttgctaagcagaggccggaagcggtggtttttagcggctctctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattacttgagagagctgctgacaaccatgggggatcggtttacagatgaggaagtggatgagctgtacagagaagcacctattgataaaaaggggaatttcaattacatcgagttcacacgcatcctgaaacatggagccaaagacaaagatgactgaaataacttcaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcatcttcagaataaaaaataggataatttaacctaccagcccttctcccccaataactgtggtctatacagagtcaatatattttttcagagaaagttattcgctcgattttttctgaatcataattaaactttatgataaaataaaaaaananaaaaaaaaaaaaaanagaaaacnaca

SEQ ID NO: 292828 - DNA, 533 bp, Homo sapiens
tgatctccctctcttctggcagcgagccttcaatgccacctcgttcctgcgccacatccggaagctggggcagatcccagagggcgagggggcctctgagcagggcatggcccgccacagccactcaggcctccgtgctggccagccccccaagtggtgatgcccagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagc

SEQ ID NO: 292829 - DNA, 1706 bp, Homo sapiens
ggcggggcgcgggcggggggcttggcgctgcggccactgcgcggcacgacgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292830 - DNA, 1215 bp, Homo sapiens
ggcggggcgcgggcggggggcttggcgctgcggccactgcgcggcacgacgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292831 - DNA, 2027 bp, Homo sapiens
ggagccttctggaaagcggccggatgtgtggaggcagagaggcagcatccaggcgctggtcgccttcggggtgcggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaaggtgcctggctggggcctctgcaccccaccctcccacctgcccacctggccctgcctttgttttcccgggagcacggctggggcctttcttgatctcctgctccaccaaggctctggggaacctgagagtgcctagtccccatcctgtcccagcaccggcaccgcgtcaggactgactggcccttttcccggtgtccgtgtgtcacagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292832 - DNA, 1683 bp, Homo sapiens
cgcggggcgggggcgcaccggatccggcccgcggccgccgcagccttgcgcgtccgcagcacacctgtcacgcctggcgcgccccctgcccgcacgcgctcggtccacgcagctcgggacgcgggcggcccaggctgccaggtccccctgctccgcggcgccgagggctgggctgcgtctgcggccgcgtgggtggccgcggtcttggcaggtggctgcgcgcgggggtcgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292833 - DNA, 2041 bp, Homo sapiens
caggcagatatctgatcgaagaacattccaggcaggggagcaaaggctagggccgtcaggaggccagtgtggccggggaagaggtggaggaggaggggccagggcagtcgttaggccgccccctaaggactcatgctttgacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggcgcttccttgccattgcaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292834 - DNA, 2134 bp, Homo sapiens
ggctgaggcctgcctggcagggggtggaggaggaagctgcccttgcccccggcggggcggggagagacccccatcacctctcccctgcccctgcagacatgctgctgctgaagaaacacacggaggacatcagcagcgtctacgagatccgcgagaggctcggctcggggccctccccgctccactctctctccctcctgcctctcctctcttcccacttccttcccacctcccaccgccccgtctgcggcaggggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaaggtgcctggctggggcctctgcaccccaccctcccacctgcccacctggccctgcctttgttttcccgggagcacggctggggcctttcttgatctcctgctccaccaaggctctggggaacctgagagtgcctagtccccatcctgtcccagcaccggcaccgcgtcaggactgactggcccttttcccggtgtccgtgtgtcacagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292835 - DNA, 2047 bp, Homo sapiens
ggctgaggcctgcctggcagggggtggaggaggaagctgcccttgcccccggcggggcggggagagacccccatcacctctcccctgcccctgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaaggtgcctggctggggcctctgcaccccaccctcccacctgcccacctggccctgcctttgttttcccgggagcacggctggggcctttcttgatctcctgctccaccaaggctctggggaacctgagagtgcctagtccccatcctgtcccagcaccggcaccgcgtcaggactgactggcccttttcccggtgtccgtgtgtcacagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292836 - DNA, 1978 bp, Homo sapiens
cgcggggcgggggcgcaccggatccggcccgcggccgccgcagccttgcgcgtccgcagcacacctgtcacgcctggcgcgccccctgcccgcacgcgctcggtccacgcagctcgggacgcgggcggcccaggctgccaggtccccctgctccgcggcgccgagggctgggctgcgtctgcggccgcgtgggtggccgcggtcttggcaggtggctgcgcgcgggggtcgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292837 - DNA, 1518 bp, Homo sapiens
ggcggggcgcgggcggggggcttggcgctgcggccactgcgcggcacgacgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292838 - DNA, 1800 bp, Homo sapiens
ggcggggcgcgggcggggggcttggcgctgcggccactgcgcggcacgacgctgcggcacccgctccagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgtgagtgaccgctgggaaggcttgtctcctgcctgcctgcccctgctgggttggggagggtgggacagctggatgattcatctgtgggtgccaggctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292839 - DNA, 1525 bp, Homo sapiens
ggagccttctggaaagcggccggatgtgtggaggcagagaggcagcatccaggcgctggtcgccttcggggtgcggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292840 - DNA, 2021 bp, Homo sapiens
caggcagatatctgatcgaagaacattccaggcaggggagcaaaggctagggccgtcaggaggccagtgtggccggggaagaggtggaggaggaggggccagggcagtcgttaggccgccccctaaggactcatgctttgacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292841 - DNA, 2178 bp, Homo sapiens
caggcagatatctgatcgaagaacattccaggcaggggagcaaaggctagggccgtcaggaggccagtgtggccggggaagaggtggaggaggaggggccagggcagtcgttaggccgccccctaaggactcatgctttgacttggattgacatagagagctgcaggagggtgacatgatctcaataaaaggaatgctctggctgctgggtagagaagaaagcgaggacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaaggtgcctggctggggcctctgcaccccaccctcccacctgcccacctggccctgcctttgttttcccgggagcacggctggggcctttcttgatctcctgctccaccaaggctctggggaacctgagagtgcctagtccccatcctgtcccagcaccggcaccgcgtcaggactgactggcccttttcccggtgtccgtgtgtcacagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292842 - DNA, 1545 bp, Homo sapiens
ggctgaggcctgcctggcagggggtggaggaggaagctgcccttgcccccggcggggcggggagagacccccatcacctctcccctgcccctgcagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292843 - DNA, 2155 bp, Homo sapiens
aggggggtggaggcgcccggcccggccaccgagcggcagcggcggacgaggggcggccccgacccccgcgtgcccgggggccacccgttgcccggacttcacccctccgcggcggctccgggggtcgggcgggggccggcggcctgctgggggaggaggccgcggcgggcgggggaactcacctccgccgttcttgtagcacagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactgtgaggagggcctgggcaggctgtgggagccggggagggactgagcagtgagtggggctgaaggccaggctgagtgcctgggtcagccaaacccctggcacccccagggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaaggtgcctggctggggcctctgcaccccaccctcccacctgcccacctggccctgcctttgttttcccgggagcacggctggggcctttcttgatctcctgctccaccaaggctctggggaacctgagagtgcctagtccccatcctgtcccagcaccggcaccgcgtcaggactgactggcccttttcccggtgtccgtgtgtcacagcccgaaaacctcctgtatgccacgccctttgaggactcgaagatcatggtctctgactttggactctccaaaatccaggctgggaacatgctaggcaccgcctgtgggacccctggatatgtgggtgagggacgacaccctgaggcttgctgggagtggggtggcctgggggaccctagacagccgggaaggctgttgtgcccgttgcctttgtgtgggccattcctgggcttgagtaggccgagccagtgacactgagcggcatggctgcgtgtgtgcctgtgcgtgcgtctgtctgtctctggcccccagccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaagtg

SEQ ID NO: 292844 - DNA, 734 bp, Homo sapiens
  misc_feature (200)..(200): n is a, c, g, or t
tttagagtccactacatacaaggtttttcactctgcattgctatgttaaaatgtgggcagagatgtgcctcagtagttaattgggccaccatgcttgttggatataaataagaccattcacttacttagccttaagtaatgcagataaatgggacaccagatggaattcatgtagtgaaattcatgcagatactgtattntatgatatgcctctttcaggggtttaatgatcatgccgccttatacttttataatgcttcgtaagtttaacaagtacagcagatattgctgatttcccacccactgcccattctccccttctttcttattcgtagaaccttgattttgttcagggaggcaatatgctcagctaaaaatatttcccagtttcccttgtaggtaggaatgatcatgtgacagccaatgagatgtaaatggaattctgctggggatatctgggtaagttttatatatctgatataggcagaactttttcttgcctgttttgtcctttttctttcctttttttttttctggctggtctgcagattgagtatggaagtggggcctctaccttgtgactgagagggagccagggagtaaaagctgcttgcagaaagaggagccagggatattgatgacatcatgaagccacttcatcagcgtggaccactggtctccagaatacctatgatgtgggaacaataaacacttacttgtttaagctgttaaaa

SEQ ID NO: 292845 - DNA, 758 bp, Homo sapiens
acttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaaggcagaaaccaaacagggcagtggaagaaaaagcacactactctcttcaactttgaacacaggaagaagcaactccttcaggacttgaaggcatttggtttttcattcctcttcagttaaaatggggaaccttgaagcagagaccaatgttttggtgctgaggctggttcagaaaaaggatttttaaaaaaagtatgtaatttttaaaagttctgatgattagaacacagacctcaggaaagtagcgtgaacatactgctggcgatggtagcagcttcgttggtttagcaaagtgacagaagtatctatttggagtgtttttctgaccctgacacggtatgtggaggtggatgaaagcagcgaagtttcatctgagaaccattgagtatggaagtggggcctctaccttgtgactgagagggagccagggagtaaaagctgcttgcagaaagaggagccagggatattgatgacatcatgaagccacttcatcagcgtggaccactggtctccagaatacctatgatgtgggaacaataaacacttacttgtttaagctgttaaaa

SEQ ID NO: 292846 - DNA, 177 bp, Homo sapiens
ctaggacaagcaagggtaaacagggatgagtgtgggtgggcccactcggaccccaccccggcctctgggtcagaaactggaagctggggtggaggatggaaagatggaggggtccggaggatggaggggcctgcacagctgtctcggggtgggggcgaggggaaggttcgcgctgga

SEQ ID NO: 292847 - DNA, 657 bp, Homo sapiens
agcaacagtttgcgtggaggccactcggtctccacagccacaaatgaagcccggcgctgcaagtcccggtccaggaagagcagcaccggcgtgggcaccacccggcctgacgcatcggccgccaaaacccagtctccgcggtgcagttcccgcagccctttccgctcgccgctccacaggcgcacagttgcatttcccggaaagcagccgcccgcccggaccgccaatgcagcccagaagggcgtgggagtagcacctgagaataacggtctccttgtgcggatctggggagccccctgcagggtggcaaccagaggaaagggccacaatgttccacggccaaggaggaaagaaggaatgccccttttcccatctctaggtaggaggaaggcttcagggcagaagcaaaaggaattatttcttccctggacaggttttcctaacaaagtaacctggaaaactatggcaattaatcagaggaaatccgtacccctccctctccccccacctccccactccatacacaattaggtggtgtaatggaaagtatatagggcttagaatcaggagtcctgaattctagtcccagccatgccactttaaattgtgagagtttaaattgcttttcctcctgggggaagtccagctctcagatgt

SEQ ID NO: 292848 - DNA, 540 bp, Homo sapiens
ttttttttttggtgacagagtcttgctctgtcgcccaggctggaatgtagtggaggttgcagtgagccaagatcacaccattgcactccagtctgggcaacaagagcaaaactttttctcaaaaatactaataagttatgttcaactcttctatatctttaataatttcttttgtctgcttgacctataatggcaaaacatgcatgaaaacctcccactataagagtaatctttttcatttctccctgtagttctatttttctttctgcattttgaggctattttattgggcacatactgtacaagttagaattgctatctcttcctggtagaattgaaagcttttaaagtaatatgggagataaattgcaaaaattgcctgaattttccactcactcctccctgtagccacaccttttgcaatgtgacttggcagctcctcccagaatctcagctggattttaactcaccttggcctaaagaaaatgacagaagtgataaagtcctcagcctgagccttaagaaaccttaaacgcttcc

SEQ ID NO: 292849 - DNA, 2089 bp, Homo sapiens
  misc_feature (1426)..(1427): n is a, c, g, or t
  misc_feature (1864)..(1864): n is a, c, g, or t
  misc_feature (1894)..(1894): n is a, c, g, or t
aattccggcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctacggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcannccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccaggatggagaattggttgagtagccaaggaaggtcagtgtgaaaagcttgctatggcaaatatagcgaaatctctccactgccttctgtccaccagcatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacangcattgctccccagccctccagaaaccttngagactctgcggtaggacagaatgctgttctggggggcacaggatctctttgtggggagggaatcagaggaggaaatctgaagtgaagacaggtgggctggggctagtgacaaggatgagatgggagaggtaggggagaaggagtggggcactttgtacccccatgaatccagagcagactccagacattctttt

SEQ ID NO: 292850 - DNA, 2677 bp, Homo sapiens
gtatatggtgagagatagggttcaggttcattaatgcatatggatatccagttttcccagctggtacctccctaggttacatgccatcccagcccactagctctaatcccagccccagccctaagagttgcctaggagttgttgtccttgtgtcctagactacctttcaggtttacctagcaccctggagcactttagcccatggtagtgagacttgccaagaaattcagattcttattgccgggatggatgagtcctctttggctaggtctggtccaaaggctccttcagtgcatgggtgctggctgagtacagcatggctttgctgtccactgtgacagagcagcactgagttcaatgtaaagtcccctagttactgcgctgtcccttcctaaagtgcacagactctgtccatgttgtggggccagattagggaggtgtgctgtcagggatttaaggctgtctctgctaccctcgtcaatgcctctttcagtgatacaaagtcaaaaccaggtagtatgaatgctcacttgatatttggttcttgtgatgatgcttttctgtgtgcagatagtcgttaaaatttggtgttcctgctggggatgggatgaacagtgtagggttctattctaccattttgctccacccagctatgtgttctagtaatttaatttttctactagctgtggaatggctactttatagaggttctataacacacatttctcaataatttgatttggtagtctaaccatgttagtgcattcctcattctttgtaacttctctatagtgtttctctgtatgaatataccacagatgtattaccaattccttactgattgatatttaggttgtttctagaaacagaactttagttaacaccttgtgtaccttcacaggccatcttttgacatttatgatagtggttttttaggtgatacctacccaatggaatggttggtttataggatgcacagtaatggataatataagattgctcactaaataactgttataatttactccctggtaatttatgagagtattaccaacaacatcttaatttcttcagctttaaaaattcgttatatagaaaatgatatctagttttaatttgcatctttttgattattcattaacttcatctttttatataattgttagctatatctattaactgtttaagtgagttgtctgtatcttttcctattttattgttgtctttttaaaaatattcatttgaaggtgcatgaatattgtgcattctagacactaattttgcattgtatgtaagaagtcttttcttacagtctgttgcttgtgttatgcatacatatatcaagtttgaattttttttttttttttttttttttttggcggagcctctctctgtcgcccaggctggagtgcagtggcaccatctcgcctcactgcaagctccacctcccgggttcacgtcattctcctgcctcagcctcctgagtacctgggactacaggtgctcgccactaacagagatggggtttcaccatgttagccaggatggtcttgatctcctgacctcgtgatccgtccgcctcggcctctgaaagtgctgggattacaggcgtgagccacctcgcccggccaagtttgatgtttttatgtactcaaatttattggtattctatggcttctgcatttttttctttattatttttatgcctgtgacacagcctcaggaggttctgaggacatgttcccctctttttgagacaaggtctcactctatcacccaggctggaatgcggtggcacaatttcggctcattgccacctccgcctcccaggctcaagtaatcctcccacctcagcctcctgagtacctgggactacaggtgcaagccaccgcgcatagctaagttttaatttattttttgtagatatgaggtttcactttgttgcccaaggtgatctcacactcctgggctcaggaggattgcttgagcccacacgatggagaggtagcactgagctgagatagcaccatggcaccccagcctgggcaacagagccaggctttgtcttaaacaaacaaagaacatggtttgtccatttagatttccttttatgccctttagcaagttttatttttttttccataaagttcttgaacattttgtggtggttaaatttattattttacttatttttacatatagctattagagaggatctttattttttagttctcatatgttttctagttagttactactagagtaacctatcatcctagtttatacctgctacatgccatccatttattcccattgtcctggtttggataataaattaaatcgtgtggccttagttattaacaattttatcatttaggatttcattcagtttcaactaataaaacctcactagtggattgttaacaaataagaggtatatttatctcataacagaaatctgcatgtaggtggtccagtgctcgtgcaacagctccataatatcttcaggaacctcgccttgtcttccagcactactgtctgtagaatgtgtctttcatcctcatttgtaagatggtttctgcaccttctggcatcttttctatcttcgagacatacaggaataaaaatgcagagcaaaatgagtttttgttttcttttctggaaagagtgagttccc

SEQ ID NO: 292851 - DNA, 928 bp, Homo sapiens
caacactaagtctttctatcaaaaaacatagttcgttggctggtggctcttgcctgttatcctagcattttgagaggctgaggtgggcagataacttgagctcaggagtttgagaccagcgtggggcaatacgatgaaaccctgtctctactaaaaatacaaaaattagctgggtgcggtggtgcatgcatgtagtcccagctactcaggaggaggctgaggcaggaggattgcttgagcccacacgatggagaggtagcactgagctgagatagcaccatggcaccccagcctgggcaacagagccaggctttgtcttaaacaaacaaagaacatggtttgtccatttagatttccttttatgccctttagcaagttttatttttttttccataaagttcttgaacattttgtggtggttaaatttattattttacttatttttacatatagctattagagaggatctttattttttagttctcatatgttttctagttagttactactagagtaacctatcatcctagtttatacctgctacatgccatccatttattcccattgtcctggtttggataataaattaaatcgtgtggccttagttattaacaattttatcatttaggatttcattcagtttcaactaataaaacctcactagtggattgttaacaaataagaggtatatttatctcataacagaaatctgcatgtaggtggtccagtgctcgtgcaacagctccataatatcttcaggaacctcgccttgtcttccagcactactgtctgtagaatgtgtctttcatcctcatttgtaagatggtttctgcaccttctggcatcttttctatcttcgagacatacaggaataaaaatgcagagcaaaatgagtttttgttttcttttctggaaagagtgagttccc

SEQ ID NO: 292852 - DNA, 1751 bp, Homo sapiens
ctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaacttagaaccttattgatattttctatacagtagttttgtgattagaattcacctggggacacacactcacacgcacagtcactcttacacatatgcctagtccagtggttctcaaagtgtgatccatagactaatagcatagcattacctgagaacttgataatgcatatttgcaggccccacgcaaaacctgctgaatcagaagctctgagagtaaggcctaccaatctggtttaacaagcccgtcaggtgattctgatttacagtacagtttgagacccactggctagaacatatcctccagagacttggcttaattggtctgggtaaatatggctgagcgttgttatcttttgttatcttttatatgccctaggaaagtacaaccagaattgaaaaccaactgatctataccagttctttcaattaatagtcaagaacattgagtccagtgagattaagtgatttttgcaggctatgaggttttatgctattcctgtgttctccaaaacaagaaaataaaaagacatgacttattctctgttcatacagcaagtatggaaaaaagatgatctagaagtcaactatctcaacctccattgttacccactaggtttttttctaataatgttaaaggctatttaatttatttaatcaactttaagcattacattctcaattggggacaaaaattggttcttggggtgaaaaaatattagatatggcttgtggacttccaatatcatcctatccaacaaaatcttattccttagtattaatttatctcattgggaagaaatttgtagttaaaactatttaatgtaatttgaatttaatttctgtaattgggaaggagggtaataatgaacaaaaagtttgagaaaaaaatgctttaatgggttttacaggcatgctacaatccaggactgtggtgttctatgtgccgtgtatggtcatattagtagctatttgttgcaagatacttgaagccaaatgtttgcagtataggttcctggctactgtttatgctgtgatttcactctgtctatcatgggcagtattagaaaacacactggttttcactatctggtttacaaacactatcattattttacctggattgaagtgcagaatttggcatatcgatgcatgcaatggaaagaaaaaaaatttgttaaaatttgtaaatgttcagctaaatctcagatatactgtgggatgagtatctcagggtaagtaacaaaaaaacaaacaaaaaaaatcactgaaatttttccctcacagtcagtagctttgtttgatatttaacaataagtatatggtgatatacttgaaatttatgtccagaatgtcactggaatattacaatgagcataaataatcaagcttaggactaaatgaaagatactatctcatgtatgctttaaatagagaatttatttcttttaaaaataaagctatttttcctta

SEQ ID NO: 292853 - DNA, 1630 bp, Homo sapiens
ctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaacttagaaccttattgatattttctatacagtagttttgtgattagaattcacctggggacacacactcacacgcacagtcactcttacacatatgcctagtccagtggttctcaaagtgtgatccatagactaatagcatagcattacagtttgagacccactggctagaacatatcctccagagacttggcttaattggtctgggtaaatatggctgagcgttgttatcttttgttatcttttatatgccctaggaaagtacaaccagaattgaaaaccaactgatctataccagttctttcaattaatagtcaagaacattgagtccagtgagattaagtgatttttgcaggctatgaggttttatgctattcctgtgttctccaaaacaagaaaataaaaagacatgacttattctctgttcatacagcaagtatggaaaaaagatgatctagaagtcaactatctcaacctccattgttacccactaggtttttttctaataatgttaaaggctatttaatttatttaatcaactttaagcattacattctcaattggggacaaaaattggttcttggggtgaaaaaatattagatatggcttgtggacttccaatatcatcctatccaacaaaatcttattccttagtattaatttatctcattgggaagaaatttgtagttaaaactatttaatgtaatttgaatttaatttctgtaattgggaaggagggtaataatgaacaaaaagtttgagaaaaaaatgctttaatgggttttacaggcatgctacaatccaggactgtggtgttctatgtgccgtgtatggtcatattagtagctatttgttgcaagatacttgaagccaaatgtttgcagtataggttcctggctactgtttatgctgtgatttcactctgtctatcatgggcagtattagaaaacacactggttttcactatctggtttacaaacactatcattattttacctggattgaagtgcagaatttggcatatcgatgcatgcaatggaaagaaaaaaaatttgttaaaatttgtaaatgttcagctaaatctcagatatactgtgggatgagtatctcagggtaagtaacaaaaaaacaaacaaaaaaaatcactgaaatttttccctcacagtcagtagctttgtttgatatttaacaataagtatatggtgatatacttgaaatttatgtccagaatgtcactggaatattacaatgagcataaataatcaagcttaggactaaatgaaagatactatctcatgtatgctttaaatagagaatttatttcttttaaaaataaagctatttttcctta

SEQ ID NO: 292854 - DNA, 1800 bp, Homo sapiens
ctcttcaagcaattcaaaaacagctggctactatccaaatcctccactggtcttatcaagtgatgagacactgatatccaaataagttgtctttactgaaaaatgaagtgaagacccatatatgcagttaaaaaaaagttaattttcaaaaaatactgtaaaagactttaaggaacaagttttattgaccaataagttgatatttgtccataggtctcctttctataaatcatcttgatgtttaacaactcttattatattaaaatctcagtatcctaaaacttagaaccttattgatattttctatacagtagttttgtgattagaattcacctggggacacacactcacacgcacagtcactcttacacatatgcctagtccagtggttctcaaagtgtgatccatagactaatagcatagcattacctgagaacttgataatgcatatttgcaggccccacgcaaaacctgctgaatcagaagctctgagagtaaggcctaccaatctggtttaacaagcccgtcaggtgattctgatttacagtacagtttgagacccactggctagaacatatcctccagagacttggcttaattggtctgggtaaatatggctgagcgttgttatcttttgttatcttttatatgccctaggaaagtacaaccagaattgaaaaccaactgatctataccagttctttcaattaatagtcaagaacattgagtccagtgagattaagtgatttttgcaggctatgaggttttatgctattcctgtgttctccaaaacaagaaaataaaaagacatgacttattctctgttcatacagcaagtatggaaaaaagatgatctagaagtcaactatctcaacctccattgttacccactaggtttttttctaataatgttaaaggctatttaatttatttaatcaactttaagcattacattctcaattggggacaaaaattggttcttggggtgaaaaaatattagatatggcttgtggacttccaatatcatcctatccaacaaaatcttattccttagtattaatttatctcattgggaagaaatttgtagttaaaactatttaatgtaatttgaatttaatttctgtaattgggaaggagggtaataatgaacaaaaagtttgagaaaaaaatgctttaatgggttttacaggcatgctacaatccaggactgtggtgttctatgtgccgtgtatggtcatattagtagctatttgttgcaagatacttgaagccaaatgtttgcagtataggttcctggctactgtttatgctgtgatttcactctgtctatcatgggcagtattagaaaacacactggttttcactatctggtttacaaacactatcattattttacctggattgaagtgcagaatttggcatatcgatgcatgcaatggaaagaaaaaaaatttgttaaaatttgtaaatgttcagctaaatctcagatatactgtgggatgagtatctcagggtaagtaacaaaaaaacaaacaaaaaaaatcactgaaatttttccctcacagtcagtagctttgtttgatatttaacaataagtatatggtgatatacttgaaatttatgtccagaatgtcactggaatattacaatgagcataaataatcaagcttaggactaaatgaaagatactatctcatgtatgctttaaatagagaatttatttcttttaaaaataaagctatttttccttatccatgtttactctgtaaatggcaaataatacatctttaaatgcttatg

SEQ ID NO: 292855 - DNA, 441 bp, Homo sapiens
attgattgtcctcatcctgcaactgtacttgcccaaccgatatttattgatgcctgcagtgtcctgggtgcctaccaaggggcacagaactggatccgacgcagaccctgcctgccttcaggttgcttgaagatgaacagagagatcggacctctgcatgaagccagactgctcatcattccagacatcttcagctgctacacccagaacaagcattcgaaatatgaacaggatggtgagccagatctttccaatcatggtggagtggatgtgaacttcctccagagtatctccaaggagattccagtcccccatgtttatttagtcagccatcttagctctgatccacatcaaataagaggcagataaattcttccattctgaagggagcactatttcttaaagcaaacctatggtgaaaatataacaatatgtcacttc

SEQ ID NO: 292856 - DNA, 874 bp, Homo sapiens
ctgagagacggaggttgcagtgagctgagatcgcaccactgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccgggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292857 - DNA, 1901 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292858 - DNA, 1845 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttcaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292859 - DNA, 1036 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292860 - DNA, 505 bp, Homo sapiens
ctgagagacggaggttgcagtgagctgagatcgcaccactgcactccagcctgggtgacagagtaagactcaatctcaaaaaaaaaaaagtcaagtccaaagcccagcctggtccccaacctgcctcatcctcaaccctatccctatctcctttcagccccatcggtggctcaaagacctgaccatgttccctctcccctgaccccggctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292861 - DNA, 803 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292862 - DNA, 640 bp, Homo sapiens
  misc_feature (43)..(43): n is a, c, g, or t
  misc_feature (510)..(510): n is a, c, g, or t
  misc_feature (516)..(516): n is a, c, g, or t
  misc_feature (520)..(520): n is a, c, g, or t
  misc_feature (555)..(555): n is a, c, g, or t
  misc_feature (557)..(557): n is a, c, g, or t
  misc_feature (574)..(574): n is a, c, g, or t
  misc_feature (626)..(626): n is a, c, g, or t
gggatgtgcgatcgcggaagcgcaggaaatggggacgggagangagtatgattacatattgaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaagaacaattgtcttcatcgagactcagctggatcataagtaagagcatcagantcaaantagngtgtaaaaatgaagtgtgcagagtggaagtgtgananggcaagagaaaaaatgngtgaattgatggttaatgtgttgttagcagtttgtttgtttttggttcattngatgcgggggcaaa

SEQ ID NO: 292863 - DNA, 2479 bp, Homo sapiens
cgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292864 - DNA, 2475 bp, Homo sapiens
ggaaactatcaggccactcgagtgcgcctgtgaggcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292865 - DNA, 2488 bp, Homo sapiens
taaccctcaccctaaccgcgtaaccctaaccgtcaccctaccgcgcggcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292866 - DNA, 1439 bp, Homo sapiens
  misc_feature (1332)..(1332): n is a, c, g, or t
cgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgggctccatggcccattttngtgcttcgggtcagaatccaaggactcctggggcatggggtcgtgaccccgcttgaaacaataacgttttgtcccggtaaaaaatacacggcctgtttttgaaaacc

SEQ ID NO: 292867 - DNA, 2438 bp, Homo sapiens
ggtgactctacaggatctcctctggggtgacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292868 - DNA, 3340 bp, Homo sapiens
cgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttgtttttttcttttttttgtcggggcaggatggagttttgctctttgcccaggctggagtgcggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcgaactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292869 - DNA, 2285 bp, Homo sapiens
ctcggtacccgaggatacgattcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292870 - DNA, 3146 bp, Homo sapiens
ctcggtacccgaggatacgattcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttgtttttttcttttttttgtcggggcaggatggagttttgctctttgcccaggctggagtgcggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcgaactcctgggctcaagtgatcctcctgcctcagcctcccaaagtgctgggattacaggcgtgagccactgcacctggcctgtttgatttttttccaccaccacccctaacctttgctttttaaacctgccggtccacctggacacttcacagggtcagaccaggtctagcccttgctggcactggggacacagagaccccctggccccagttcctggggatgggccctgccttaactcttggcgctgcggggaggcgggtagcctcagggacctggagccttttggcttctgggagtttacctctgagggaggagggcgcttctgatcttagggagcgagaggccggggctggctgtgaccagatgtgggtcctggctgggtgcgcagcccctgtccttgttacccctgatgtgatgggggcgctgtgggggtctggagagggcctctggagtcctgcagggaggggttcccctcggcaggcagggcacgtgctggctcaccccacgtccccctgtaccccctttgcagagatctaccgcatcgtgtcacagaaacagatcgcagaccgtgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgtccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctctgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292871 - DNA, 2753 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaacaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292872 - DNA, 1787 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttccctgcctgggcaggggctccaaggaggggccatctggaaacttgtggacagagaagaagaccacgactggagaagccccctttctgagtgcaggggggctgcatgcgttgcctcctgagatcgaggctgcaggatatgctcagactctagaggcgtggaccaaggggcatggagcttcactccttgctggccagggagttggggactcagagggaccacttggggccagccagactggcctcaatggcggactcagtcacattgactgacggggaccagggcttgtgtgggtcgagagcgccctcatggtgctggtgctgttgtgtgtaggtcccctggggacacaagcaggcgccaatggtatctgggcggagctcacagagttcttggaataaaagcaacctcagaaca

SEQ ID NO: 292873 - DNA, 1434 bp, Homo sapiens
ggtgactctacaggatctcctctggggtgacaatggggacccgggacgacgagtacgactacctattcaaagtggtgctcatcggggactcaggcgtgggcaagagcaacctgctgtcgcgcttcacccgcaacgagttcaacccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacaagaaaaaaaaaaaaaaaaaaaacaaaaaaaaaaaaaaaagggggggccgcgtttggaaggatgacctctaggaaaaaagtgttgctgaaggttatcatccggggaaattctggagtcggggaaagacattcactcatgacccagtattgtgaataagaaatttcacgcaagtcatgtacaaacgccacaataggagctgactttcctgaccaagggaggtgatggtggatgacagggctagtcacagaggcagataatgggacacagcaggacaggaaccggtctccagtcatcctcggtgtggcctctctacaagaggtgcagactgcatgcgtgtcggggtatacggattgtgattggccccccaagaacatttcaaaacccttagatagctgggacgagatgagtattctcaatcaaagggccacgtccccgagatccctgaaaaacttcccatttttgttggtgtggggaaaccaaagattgtgacctcgaaaaccagacaaatgttggccacaatacggggcaccaggggcatgggtgctacagggcaaaaaccaacgatttcccatacgtttggaagaccagtgtgcccagaggaggggccatatccaaacgttggagcaagggcggttacccagaaccgaatgggcacgggaacatgcacttaaacaccaggagaaccgggatggtagggacgcaggtaccaacaggaaattttccgtgaaccctaatacaaacgtggacacagtatttgacccggggccagggcctcggcgaacaaaacgctgaaattgctgaggggggcactgcaatttgacagcgcacagaagtctacaaaaaccaagaaccctggtaggcctcaccacaattacct

SEQ ID NO: 292874 - DNA, 1566 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctccgcagggacaagaactgcgccaagagcctctctggaggctggtggtttggcacctgcagccattccaacctcaacggccagtacttccgctccatcccacagcagcggcagaagcttaagaagggaatcttctggaagacctggcggggccgctactacccgctgcaggccaccaccatgttgatccagcccatggcagcagaggcagcctcctagcgtcctggctgggcctggtcccaggcccacgaaagacggtgactcttggctctgcccgaggatgtggccgttcctggggacacaagcaggcgccaatggtatctgggcggagctcacagagttcttggaataaaagcaacctcagaaca

SEQ ID NO: 292875 - DNA, 827 bp, Homo sapiens
cgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttctttttgtcgggcaggatggatttttgctcttgccaggctgagtgtggggcgactcagatattgaactcgcttccagttcggcatctctgctcgctccggtctggatacggtcgccccaccgtattggattaggaaggttccgg

SEQ ID NO: 292876 - DNA, 1414 bp, Homo sapiens
tataaaaaccgtcctcgggcgcggcggggagaagccgagctgagcggatcctcacacgactgtgatccgattctttccagcggcttctgcaaccaagcgggtcttacccccggtcctccgcgtctccagtcctcgcacctggaaccccaacgtccccgagagtccccgaatccccgctcccaggctacctaagaggatgagcggtgctccgacggccggggcagccctgatgctctgcgccgccaccgccgtgctactgagcgctcagggcggacccgtgcagtccaagtcgccgcgctttgcgtcctgggacgagatgaatgtcctggcgcacggactcctgcagctcggccaggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcagacacaactcaaggctcagaacagcaggatccagcaactcttccacaaggtggcccagcagcagcggcacctggagaagcagcacctgcgaattcagcatctgcaaagccagtttggcctcctggaccacaagcacctagaccatgaggtggccaagcctgcccgaagaaagaggctgcccgagatggcccagccagttgacccggctcacaatgtcagccgcctgcaccggctgcccagggattgccaggagctgttccaggttggggagaggcagagtggactatttgaaatccagcctcaggggtctccgccatttttggtgaactgcaagatgacctcagatggaggctggacagtaattcagaggcgccacgatggctcagtggacttcaaccggccctgggaagcctacaaggcggggtttggggatccccacggtaggtgtttctagtggggacagaggcaggggaggaagagggaccctcagaagtggccctgcctcatggagtggcctctcccactccaggcgagttctggctgggtctggagaaggtgcatagcatcacgggggaccgcaacagccgcctggccgtgcagctgcgggactgggatggcaacgccgagttgctgcagttctccgtgcacctgggtggcgaggacacggcctatagcctgcagctcactgcacccgtggccggccagctgggcgccaccaccgtcccacccagcggcctctccgtacccttctccacttgggaccaggatcacgacctctgccaaggaaccctcgcgcgtgggttccttgccagagtaggttaacccgggatcagatgctagagcttgctgaggctccacccttgtctgtagatgacagaatgtgggtggtgggaccagtcgg

SEQ ID NO: 292877 - DNA, 513 bp, Homo sapiens
  misc_feature (408)..(408): n is a, c, g, or t
  misc_feature (412)..(412): n is a, c, g, or t
  misc_feature (419)..(420): n is a, c, g, or t
  misc_feature (469)..(469): n is a, c, g, or t
cgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggaggggggggaggngggngagaggnngagggggaggagggggggggggaagaagagggaggggggggaggggggnggggggggagggaggagggggggggggggggagaaaagaagaag

SEQ ID NO: 292878 - DNA, 654 bp, Homo sapiens
cgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtgcgtgtcggcagcctgggcagggacgctgagattcgggggcgtgggcttgcagcgcgtgggcttggaaggatgtgtaggagttgggcaggagaaggggagagtgtgctcccaagaccagggagtgaggctggaagaacactttagccatgcgccgtgggaccctcaggctgaccagcgcccagccttcgccacaccagggtatctctgggtaccaagtgcagtgaggacctagctcaggccactccgccttgccgctgcccctgcccagccagcatcccagccttcctcctccctcagcttccctcctcactggtgcccacacctggtcccacacgcctcctg

SEQ ID NO: 292879 - DNA, 278 bp, Homo sapiens
cacctgcgaattcagcatctgcaaagccaggtaaccctaggatcaagggagaaaaggtccctctgatagctggaccccaggttgagagggaggtggtgagaactggacgtgtggctggggacgtggggccaggcaggacctgacaccctcctcccgtcccatcctagtttggcctcctggaccacaagcacctagaccatgaggtggccaagcctgcccgaagaaagaggctgcccgagatggcccagccagttgacccggctcacaatgtcagccgc

SEQ ID NO: 292880 - DNA, 417 bp, Homo sapiens
ggggctgcgcgaacacgcggagcgcacccgcagtcagctgagcgcgctggagcggcgcctgagcgcgtgcgggtccgcctgtcagggaaccgaggggtccaccgacctcccgttagcccctgagagccgggtggaccctgaggtccttcacagcctgcaggtacgtgtccccagggctggttctccgcgcccctagtggctctcctggcttggaagggtatggacaggagtggggcgtgggggcggggtgcgcaactgtggctccctgggcttccctgcgtcaagggatgggctccccccttaggaagccgaggagggaggttcgctcaaggccaggaattcaagaccacctaaagcaaaatagcgagacccccgtctcttctacacacacacacacacacacacaaaataaataaa

SEQ ID NO: 292881 - DNA, 572 bp, Homo sapiens
cttgacctggagagactcagatctccacgaaggcaggatgtgtgtgatctgcagaaagaataactggatgaagaaatgaatgagcagtggaatgaacgttttgtctgctgccctgtgccagtccagtgcctggcaagtctgcccaggggtgaaggaggtcaacaggcatgcctcttgtcctccctctcctaccttaggggtctatggctcagcccttctatccatcttgtgttggtttttaaaaggcagagagactatggtaaaatggtaataaaacaaacaacaaccaccaccaccaccaccaaaaaaaaacagagctgggatcacacacacctggtcttcaatccctggtttcatctctgcccttaactaaaccagctgtgtgactttgggcaagtgactgaactctctgaaactccatttcgtcatgcatgctggggatggctaacagtagtccttacctcacagagacactacgaggattaaatgatgaaatgcatggcacatgaccaacctagagtaagtgtctgaatgtgcggtgattctatcagtcaggacattgttggttgcta

SEQ ID NO: 292882 - DNA, 2726 bp, Homo sapiens
gcaattgcaagagcaaagattcttccttttcccttttttcctgggggggtggggggtggggtggggggagggagcgcccccagacattccaggacatcaccccctgccccaagcacgcaataaacactgacaagaaaaagtttttatttcctggttcaactttttttttttcccctggaatatagactgaagaatgggaataaacacgaattaaataacaaagcgaggccgcgcacgccgggatgcgcctggctgcagccggcgaggctatggtctccccgccctgaagccagccccggcgtctttctccagctcgtttcctttcccggccttttcttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccagatgagatggaccaaacgcccccggcgcgtcctgaatatctggtctcagggattcgaactccccctgtgaggaggaacagcaaactggccaccctgggcaggatcttcaaaccctggaaatggaggaaaaagaaaaacgaaaaactgaagcagacaacgtcagcgctggagaagaagatggccggcaggcaaggccgagaggagctcatcaagaaggggctgctggagatgatggagcaggatgctgaaagcaaaacttgcaaccccgatggaggaccccgatctgtacagagtgaaccacccactcccaagtcggagacgctgacttcagaagatgcccagcccggaagccccttggccactgggacggaccaggtctccctggacaagccactgtcctcagctgcccacttggacgatgcagccaagatgccttctgcatccagtggtgaagaagcagacgctggcagcctcctgcccaccaccaatgagctctcccaagccttagctggggctgactccctggacagtcctcccagacctctggagagatccgtgggccagctccccagccccccactgctgcccactccgccacccaaggcaagctccaaaaccacaaaaaatgtcacaggccaagccacactcttccaagcctccagcatgaagagtgccgacccttccctccggggccagctctccacacccacggggtctccgcatctcaccacggtccaccggcctcttcccccaagccgcgtcattgaggagctgcacagggcgctggccacgaagcaccgccaggacagttttcaaggaagagaaagtaaagggtctccaaagaagcggctggatgtccgtctgtcgagaacgtccagcgtggagcggggcaaggagagggaggaggcttggagctttgacggggcattggagaacaagcgaactgccgctaaggaatctgaggagaacaaggagaacctgatcataaattctgaactcaaagacgacttgcttttgtatcaggacgaggaggcgctgaacgactccattatttctggaacactgccacggaaatgcaagaaggagctcctggccgtgaagctaaggaaccggccaagcaaacaggaactagaagaccggaacattttccccagaaggactgatgaagaaagacaggagatccggcagcagatcgagatgaagctttccaaacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaa

SEQ ID NO: 292883 - DNA, 1174 bp, Homo sapiens
gctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaagtttgggcgacagatcagaaaaatgaagacctgcacatgtgggagctggagcaaggactagtctagtattagctctgtgacgggagagctttgactgtcacctggaagtctgacttgattttgccagcaagaggcaacaaccaaaggttcactttctctcctcccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagtatcaccccatggagtcattgttctaataatcaccaattcagactcagatcctcgtggtctatcgagcatgctgcttgctgtctgtgcagctcccatttccccttcttcctgatagacttggagctgtgtgcctccactccaaggctgcctgcctactgtaaacactattccacctggta

SEQ ID NO: 292884 - DNA, 1587 bp, Homo sapiens
gctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaagtttgggcgacagatcagaaaaatgaagacctgcacatgtgggagctggagcaaggactagtctagtattagctctgtgacgggagagctttgactgtcacctggaagtctgacttgattttgccagcaagaggcaacaaccaaaggttcactttctctcctcccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaa

SEQ ID NO: 292885 - DNA, 2135 bp, Homo sapiens
  misc_feature (2135)..(2135): n is a, c, g, or t
gctggctggaagagattcccagtttttattcagcgctcgagctgggctgcatgcttgctgacaagaggcgggaggccccttagacgtctttagacactccccctgtgctgggctgggcacaggcggctctactcagcagttcagcaggcagaaagccggaaggagagatcagtgctcccaaggctggtgtctcccgtgctgacaacggaggcagtgctgggaagcatgaatctcccagcatctctggatccagaagcctgaaaacaggtggtgctacccacccctccctaagccaatgggcaggaaaaagaatttcctgaacagatctcctcgctgcttaaacacactgctccggtgaacagtccagaccaggcaaagtttgggcgacagatcagaaaaatgaagacctgcacatgtgggagctggagcaaggactagtctagtattagctctgtgacgggagagctttgactgtcacctggaagtctgacttgattttgccagcaagaggcaacaaccaaaggttcactttctctcctcccaattttgggaggcgatctataggggtttgccagccacctctcatccttgcagaccccaggtggaatttgcaggcagccactatggtgcaaaatgtaattttagtgtttttccgcagacggctgagccaaagacctgccgtggaagagctggagagaagaaatatcttgaaacaaaggaatgatcagacagagcaggaagaaagaagagaaatcaagcaaagattgacaagaaagcttaatcagagacccactgttgatgaattaagagacagaaaaattctgatacgattcagtgattacgtggaagtagcaaaagcgcaggactatgacaggagggcagacaaaccctggacgagactgtcagcagcagataaggcagcaattcgtaaagaattaaatgagtacaaaagtaatgaaatggaggtacatgcatcaagcaagcacttgacaagattccacaggccatagagattttcttctgagaagaatttgtgtttaattttttgataccaacactgaacattcatcagggaactttcctgaagttcagctcaagactaccctacctgctgtgtttgtgagaagagtaggatcacacacacaggtgcaatcttgaccacacttacctgcaagaggagtaaccagaggacacacttccttccttctttggtgtctgaggagtgtgaactgttggggtcagttaagacccaacataactctatcagaagaaaactgttgtttgcctttcaaccttgttttacagttctgcagtgtaatggaggacgggcaacgtgcatgtgcaggctcaccactcccaggcctctgacatgagggacatgtgacagtgtcattcagtattatgttcaaaagacatttttatcctgatcataattaatttgaaaactctttaagttcatgttatacaagatgatttactgtattatacttttccttttttatataatgtctaacaaaaaatacagctgcaacattttgattcctgttaattttgttctttaattaaatgactacttattgcaggaaaaaaaaaaaaaaaaaaaaaaaaaaaaaaaaaaaaaaaaaaaaaaaaaaaaaaaaaaaaaaaaaaaaaaaaaaaaaagggggggcggcgccacaaaaaatacacacgcagagggggcagaacgagcaaaataccgcacctagatactatattacagaagaggggacccagcaaacagagagggtaataataaaaaacagcagaagcagggacgcgcgtttaacaaaacccagcatggggcaggacaacacaacacagcaagagaaacacatctgcgagaagaacaaccccccctcaggtatggggggggacagacaacaatcgaggaggagaacgacacccacaatacagcaagcagaggaatgaagccgaccgccggccgaagggaacacacaaaatcaataggcagcgaacgagctaggaagggagacaaaaaccaacgcgccaccatcagcgcggccgagcagaagaaagactgcaggcaaccgagaggagagaaacgaacgagcgcaaacatatctacagcaggcggaaagaacaaacaagggggn

SEQ ID NO: 292886 - DNA, 321 bp, Homo sapiens
gtaagtgggacccgtccctggcttggaagggcacggtgctgggaatgcagaatggaaagtctcacatgagcccaggaagcccatcagaaacagtgtagaatccaaggagggccgtgttcagatgaagcctgcaaggttggagagacaccccatgtcaggagccattccattggtccagcccccaggggcacgggagaccccattactgagctgaagagctccccctcatggcaccactcctctctggggaatgtctaacagagctgggtgtgcatgaatctggtggtttatcccaattcctttaaagtggtagcagtggtt

SEQ ID NO: 292887 - DNA, 389 bp, Homo sapiens
taaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcc

SEQ ID NO: 292888 - DNA, 265 bp, Homo sapiens
gatacttaactatgatgatctttaattttagcttaatcagagacccactgttgatgaattaagagacagaaaaattctgatacgattcagtgattacgtggaagtagcaaaagcgcaggactatgacaggagggcagacaaaccctggacgagactgtcagcagcagataaggtacctaactgcctgtgctggtggggggtgttggatgatataataaaggcaaaatatgtcatgccagggagtttattcatagacaatgggagc

SEQ ID NO: 292889 - DNA, 2516 bp, Homo sapiens
atctgcctgactttcacttttggtgctggagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagataca

SEQ ID NO: 292890 - DNA, 2506 bp, Homo sapiens
atctgcctgactttcacttttggtgctggagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgtcccccaaccccagccctgggcagccccgcaccaagccagcagggccggggacttgtagggagcccagggtcccctctgctccaggctggctggccgcacactgactagcccctgggtaccctccagggcaaaccccactctcacccccttcctgtacccagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagataca

SEQ ID NO: 292891 - DNA, 1891 bp, Homo sapiens
caggctcctggtagtgcggggggcacctgggtgggcacctctgaatgctggcatctggacattcgccagcctcgcctggtcccggccctactgacccattagccgtgactccagacaactcagctgcagggggaaatcagggtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagataca

SEQ ID NO: 292892 - DNA, 1275 bp, Homo sapiens
ctggaagagcctgacgctggggttgtgtcctgagtttggcaggcttctgggatcgctggccgagacaagcccaggattgtcctccggggttggccatgtcctcccaggcagctcctggtgggaggtgctgttgctgttggggtgccctctccccggcagggcagggacctgacttccagccttgcccgcagtttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagataca

SEQ ID NO: 292893 - DNA, 1545 bp, Homo sapiens
atctgcctgactttcacttttggtgctggagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgagatgctgctgtctgcgagacttgacctgggacaggacgtgcactgagggatcatccgtgtggcctccaacagcaccacccactccagcaccacctccaccagcaccaccaccagcatctccacagacaccaccaacacctccatcaccacctccacacagacaccaccaccaccaccaccaatcccgataccatcaccaacagcaccaccactgtccacacccac

SEQ ID NO: 292894 - DNA, 488 bp, Homo sapiens
tggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtcagtatgatgtgggaccttttccttaggagacccagggtgggagggggactcttcactttcacctctctggctggcagtaggtccagagacctggagtgccacagaagggccatggcatgagcggcaccctcgctagggagggacattggtgattggcagtcctgggctaagtgttgcagcccgaggtccgtggctcccatccagcccagacaggccaagatgggctggcacagcattggctcaaatggtgatttaaaaaatacatttgtaactagttgctaacatttaaaaatcagaagattttcaaaaacaaaca

SEQ ID NO: 292895 - DNA, 842 bp, Homo sapiens
ggcacttcagtagaaattaaatcagtttggggacacatcaggctgctaaattctgtactagaatccaacagcaaatgagtcattcttggaagtggaagaactccatgatttcacagcctagaacactaagtatgaccaccaacgcaccatttcaactatctaacaaccaatgggagagtcaattgttctcatcccaactgccaaaagcaaaaggcaggccatcacaagttggcttgttcaccttctaaagacatgactttatttctgcctaagtcatctatataagcgaatctaataaatacaataaaatgtaacccaacaaaattctcatgtcactttttacagacatgggtatatgagaaccatggaggtgctaaagaaaaatagaagcattttcttattatcatattaccatgaaattaaatttatgtctgttctaaggaaagaaactaaatgtcctgtttgatattgatgagtaggcctactcattctctaccaaaatcctaaaaaaaataaaaataaaatttcacttaaaaaataatttcctaggagggcacagtgctgtaatcccagcaatttgggaggccgaggcaggagaatcgcttaaacccaggaggcagaggttgcagtgagccaagatcgcgccactgcactccagcctggcgacagagcgagactccgtctcaagaaaaaaaaaaaattccatcttttagattatgtgctaataattctcttttaagtgttggaacaggggaaagttcacattatagagtacaaaggatcaaaatggatccctccaaaatggacatccccccagaaaaatgcttataactttgaaacac

SEQ ID NO: 292896 - DNA, 2079 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292897 - DNA, 640 bp, Homo sapiens
gctgccccggtatccccgtgtggggcaggaagtgggcttccagattcccagtatccccggtagggtctgcttctgctcgctcgggaagggcggtggccgtcccattactcaaccaaccctcaacgcactggtcctcccagttccctcccctcagtgggtaaacaaacacacaccagcgcttgactcgacagactcgaaaacaacatctactcagaaaagttgtttctttcctatctccttaaactttcccacttccacatatcggagcttcttcccacctcggcctactcaagcatgagatccggaggcgggaggtgggtttcaacacaaaaccttgggtagatgcagtttacttttgggtggacgtgttgacacgttttgaggccttacattcgcttaagatcacagaatttcctcagtagccttaggtttaaaagttcaaattacagtaaaaaaaaaaaacaccctgagtttctcttccttttcatagttcacccactgctaaatttcctgtgtgtcctttcagacgcttttcatatgcattgctgagtatgtataatatctctcctaaaaagcaactgggaacaacttcctgttgtgcgtttcgtcttattcacattaacttctccattgctacgcc

SEQ ID NO: 292898 - DNA, 293 bp, Homo sapiens
ggcagtccttggctccattagactaaagctaaggaatgggagtgaaaagggttccctgcctcacccagcagctcccacctgaacccatcagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292899 - DNA, 2070 bp, Homo sapiens
caaaatatgtataagtacgatgccgcctttaatcagccgaggccgggtagcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292900 - DNA, 2255 bp, Homo sapiens
gctgccccggtatccccgtgtggggcaggaagtgggcttccagattcccagtatccccggtagggtctgcttctgctcgctcgggaagggcggtggccgtcccattactcaaccaaccctcaacgcactggtcctcccagttccctcccctcagtgggtaaacaaacacacaccagcgcttgactcgacagactcgaaaacaacatctactcagaaaagttgtttctttcctatctccttaaactttcccacttccacatatcggagcttcttcccacctcggcctactcaagcatgagatccggaggcgggagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292901 - DNA, 2122 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgcaaaaaaaaaaacatcaaatgaacacagaaaccaaaaaaaagggg

SEQ ID NO: 292902 - DNA, 2028 bp, Homo sapiens
actctagaggatctctgctttgggacggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292903 - DNA, 2263 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgcaaaaaaaaaaaaaaaaaaaaaaaaaaaaaaaacaccggggggccccatatagggggggggggggaaaaaggggtatggaaggggacatgggccaagggggttcccggcccggttttcgtggccaggggggaaaactcggggccccctaggggggggaaaaatgaaacgcggtcccgtaagatgga

SEQ ID NO: 292904 - DNA, 2209 bp, Homo sapiens
agcggggggcgcgcatgcgccccggcggctgccgctgacactgcgcctacacagacagaggcgcctggggcttggccacgttccgtgagaccaggagttcgagtccggttcctgcccgcgggtcggggcgggaggctgggccagatgggcggcaggaagtgccaggcgctgacttgcaggcggcacccccgcggcttgtaaacgccgggcggacgcggcacaggcggagtacgcgcctcgcagccgcatctcctttctgctccgcgagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292905 - DNA, 1703 bp, Homo sapiens
ggacgcgtgggcgaccacgcgtcggtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292906 - DNA, 2060 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggaggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgcaaaaaaaaaaacatcaaatgaacacagaaaccaaaaaaaagggg

SEQ ID NO: 292907 - DNA, 1891 bp, Homo sapiens
  misc_feature (19)..(19): n is a, c, g, or t
  misc_feature (1891)..(1891): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagggcaatgtacacatgctccctggcgatctcacttcggctgaagagttcgccaccgatgtttttactagcattctgtccgagtaagcacgctcaccctggtacctggcattgcttaactttagtgtagcgtgcccgtcn

SEQ ID NO: 292908 - DNA, 1616 bp, Homo sapiens
tagtcggaccgtgatggctcccaggtgtctctctctaagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292909 - DNA, 1986 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292910 - DNA, 2017 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292911 - DNA, 1820 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctctcttctggttcttctcccaggtattctcttcccaggcctctctggccactgctttgtatcagggtttttcacgcttttgtagaactgaggtttcaataaacagtttcagttgca

SEQ ID NO: 292912 - DNA, 1777 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttcctctggccactgctttgtatcagggtttttcacgcttttgtagaactgaggtttcaataaacagtttcagttgca

SEQ ID NO: 292913 - DNA, 1629 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatggtggccagtaagtacctctatgatgaaggggaggaggaggaggtcttcaacgacgaatggggagctgctgggggtgtggccgtgcccactctcaatgccttggagaggggcttcctgagtgccatggattggcatctctacactgaccctcgggagatctttgaggtgctgagctggttggagagctgtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcatctggccactgctttgtatcagggtttttcacgcttttgtagaactgaggtttcaataaacagtttcagttgca

SEQ ID NO: 292914 - DNA, 1286 bp, Homo sapiens
  misc_feature (15)..(15): n is a, c, g, or t
cgctagtagagccgngtgttatcggacgagggctcctctgccagtggtggtaagctgtcttgcctgttagctgtggcatatgtgagcagtgtggccctggctgtggcatcggtggccgtaatacatcagtctttggggctgtcctgcatccctacacctgggccgcctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292915 - DNA, 1232 bp, Homo sapiens
actctagaggatctctgctttgggacggcgggcaaggacagctccgcgagccccctacaactcgtttccttccgttcaccttcgcagggcggcgactggcggcgcgatggacctgaccttggactgacctcccgttgcctcctggagccctgcataccttctgtgccacaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292916 - DNA, 1263 bp, Homo sapiens
tgctggtgttctagaggatcccttcttgtgctggcgtgtgttctccggtgtggctgagcagcagggacggtggcgaggctggtacacctacacagacctgtgtgtgctgctggagcagccgacctggcagttggccctgggctccctctgccagcggctggtaaagctgtcttgcctgttagctgtggcatatgtgagcaaatgcctgccgtctcccgctaatgtctccagctgcctggaaggcagcatggggctgcggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292917 - DNA, 1088 bp, Homo sapiens
  misc_feature (22)..(22): n is a, c, g, or t
  misc_feature (61)..(61): n is a, c, g, or t
  misc_feature (67)..(67): n is a, c, g, or t
cctccgttgctctgaccctgantctttttccaaaatcctccgtttttcctatttctccagntcctgnaggcagcatgggctgggtcactctggggcagtcttctggcctcactgactcctccaccattgcctcccccagacccccctgcccctcccactcttcttcataactgccacctttgccagaagctccagagagactccccaacctgccatgcctgcctccaccccaaccgtacagtccccactgcgctgtccagcccctggtaccatacctatggcctggctcccccctggccttggagcccggtgcccctttcacttcctcagcctcagcaatgttcccttttcagtgtcatggagctggctcgcctcaagtctttcgttttcccaggctaggtagggctgtgaggaatgcattaagagggtttgggagtttctgagaacctggaggagcaaagcttgattcagatcctgtctgcctcgctgggtccttggcaggtcccctgtcctcctgggtgggagcttatggggtggtggggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292918 - DNA, 717 bp, Homo sapiens
ttggaaactttgatctcaagaactctcttgatggtgggcacaagacagatagatgattgctgctttcctttgccaaacttggatgcatttttctctttgtttccaaagtataggcaacaggttaaactaccacgtggggtagtttatcaatcctcccgcctcatccttgggcagaaggactgaaggtaattcactcctagatcgcagtggctggctgcttggccaggacagtgatgccgccagggagagcttccgcttggtgaccagggacatgtcccagatggacatagaagcccctctctgcctccctgggattttttagacttttacttttgatttccctaggatggaagagtataggtgggagataagggaagtggggtgagaggagaaaggaaatgttggcatgggcctgtgtgatgtccctgaggcagaagagccggggactgatgggttcaggtgggagctgctgggtgaggcagggaacccttttcactcccattccttagctttagtctaatggagccaaggactgctgggaccttcaaccctgatcttttgtcttccagtcttctcttagtgtcctgctcctaggtttccctctcttctggttcttctcccaggtattctcttcccaggcctctctggccactgctttgtatcagggtttttcacgcttttgtagaactgaggtttcaataaacagtttcagttgca

SEQ ID NO: 292919 - DNA, 696 bp, Homo sapiens
  misc_feature (19)..(19): n is a, c, g, or t
gccgccgggggagggagcngcgagggcgagggcgaggacggcggcccgccccggggaggcaggctggcaggtggacaggcgggcaaggacagctccgcgagccccctacaactcgtttccttccgttcaccttcgcagggcggcgactggcggcgcgatggacctgaccgggctcctgctggacgaagaaggcaccttctccctcgccggcttccaggacttcacgttcctcccaggacaccagaagctgagtgcccggatccgaaggaggctctactatggctgggactgggaagccgactgtagcctggaggagctctccagcccggtggcagacattgctgtcgaactgctccagaaggcagcccccagccctattcgccgactccagaagaaatacgtagctcatgtgtcccgggaggcatgcatctccccatgtgctatgatgctggctctggtgtacattgaacggctccggcaccgaaacccagactacttgcagcatgtgtcatcctctgacttgttcctgatctccatgatagtacctctaagcgccacccgatgagccaccggctcgttgtgcaccatgaagttgagacagagatggagacacctcagccccacctctctggaacaggaaagatgattggggagggagcacaggtcagcgtgggaagagggtcatggtggacatgg

SEQ ID NO: 292920 - DNA, 4507 bp, Homo sapiens
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatggtaagtccaagccctccctccagccagggggacagggcagtgcatgtgcttgagactgagccaacccccagtgtgtggccccacccatgttatttttgtttttgtttttgttttgagacagggtctcactctgttgcccaggctggagtgcagtggcgtgatctcggctcactgcaacccccacatcccgggttcaagtgattctcctgccttagcctcccaggtagctgggaatacaagcgtgtgcccccacagccagctaatttttgtatttttagtagagaggggtttcacagtgttgggcagggtggtttcaaacttctggcctcaagtgatccacctacctagtttcccaaagtgctgggaatacaggtgtgaaccaccacgttttgtcccccggctgcatattatttaacagcaaaggcatcataggggttggcacaggagccctgctgccagaacaggcctccataccaggcatgtgtctctctctaaacgccattgggttttttagtgctcatttgttttatgtattatgtgtgtatgtatgggacagggtctcactctgtcacccaggctggaatgacgaagtgaagtagtgcaaacatagctcattgcagctttgacctcctgggcttaggtgatcttcccactcagactcctgcgtagctgggaccacaggggtatgccaccacacctggctaattttttattttcctttttgtagaaacagggtcttgctatgttgcccaggctggtcttgaactcctggcctcaagcaaccctcctgcctcagtcttgcaaagtgctgggattccaggtgggagccactgcacctggctcttgcacttgtttatttataggagccagccctcagaagacaaacacaatgcaaaacatttccttcagggaagcctgctggccgccctgagcgctcttccctcgttttacatcctcactctggagatagatgggctccctcggttagctccatcaacatgtggatggaaccctctgctattgatgactacatttaatttctttttgagaaaggtgttagatgttacggtgccttctagtcttttgataattaaacctttggcaaaactcgaatgtttggttagcaaccaagcctatttttctctcctttgacccaaccgctattctacttgattttggtcggtgaggcccgggttatttttgttgatccgtgagcccatttttggtgctgggttctcacatccaagtgttcctgggttccgtatgattccagactgacgctgaacatctgtgcctgccctgcttcttgttgttgcttctgtcatttctgtcattgtgaagacggatccaaacacagaagaacaaagacccagtccaagatccatccagattatgtggtttcggcttgtgctctgcagtccactttgggtcatgcttgctgcgagcacgtccgtgaacgtcagctgtgggcctcgtgcagggacgctcaggctgctcccagcgggaccacagttttggcctctgaaacacagctgaagaaaggcagagtgctttctgtgatcttttaatcaatgttttccacttttgcattcctaggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaa

SEQ ID NO: 292921 - DNA, 425 bp, Homo sapiens
  misc_feature (10)..(10): n is a, c, g, or t
  misc_feature (346)..(346): n is a, c, g, or t
aagagctggnagcgtcctccagttggttgaacttgatggctgttctattctctgcatcttgtgtaagtcctgcaggtctttcaggttctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggaatctgcagaatgagccnaccccggcaccggaggacatagctgcccgcctcactggaagacttcacagacaatgctactatttttcagtgagacaca

SEQ ID NO: 292922 - DNA, 3967 bp, Homo sapiens
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtatatatatatatatatatatatttttttttttttttaatgtttcatttcctcagaggaaccaatcacttggaatgtctagaaatatccttgcagattttgccagtgtcaatcaagcctgcacacatgcacagtgaagcgggctgtgctgccttgagcccatcaccagccaacattcttgatgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtaggcgtcacatcagccaaaggcagagatgctagaaagatgggaaccggctacgtgttacctggaaagtttgttttcttaagtcatattccaaaaacataactccaaggcatacgcatgataaaatgcaagaataaacttttggccactttgtggaactcttaaaagaacctttccagccgggcgcagtggctcatgcctgtaatcccagcactttgggaggccgaggcaggcagatgacttgaggtcaggagttcgagaccagcctggccaacgtggcaaaaccccatctctactaaaaataagaaaattagccgggtgtagtggcacatgcctgtaatcccagctactcaggaggctgaggcaggagaatcgcttgagcccaggaggcagagattgcagtgagccaagatcgcaccactgcactccagcctcggtgacagagcaagactccatctcagaaaa

SEQ ID NO: 292923 - DNA, 3856 bp, Homo sapiens
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtatatatatatatatatatatatttttttttttttttaatgtttcatttcctcagaggaaccaatcacttggaatgtctagaaatatccttgcagattttgccagtgtcaatcaagcctgcacacatgcacagtgaagcgggctgtgctgccttgagcccatcaccagccaacattcttgatgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtaggcgtcacatcagccaaaggcagagatgctagaaagatgggaaccggctacgtgttacctggaaagtttgttttcttaagtcatattccaaaaacataacaaagtgctgggattacaggtgtgagccaccgtgcccggcctacacaccagctttctattcacctacacacaactgatgctcttttggagtggagagttttagtaaaatatgatggggtcttcaggcacctgagttgctacttactactatgagaagatagaaaatgttttttcctctaaacagcttttgaaagaatgaatgcacaacaaggcaaaaaataaaaactttcttttccttttctacgaaaaatg

SEQ ID NO: 292924 - DNA, 3967 bp, Homo sapiens
cgcgcgcggcagccccgaggcagcagagcgcggagccgggagcgcggggagcgcgggccggcggcggcgagggaggacgggggcgcagacggccggcgcgcggcgcggctaccatgggcgtgcggtgagcagccgctcgggacgacttcctcggctgcgcggcgctcgcgcggagctccccggccggcggtgcgtccccacggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtatatatatatatatatatatatttttttttttttttaatgtttcatttcctcagaggaaccaatcacttggaatgtctagaaatatccttgcagattttgccagtgtcaatcaagcctgcacacatgcacagtgaagcgggctgtgctgccttgagcccatcaccagccaacattcttgatgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtaggcgtcacatcagccaaaggcagagatgctagaaagatgggaaccggctacgtgttacctggaaagtttgttttcttaagtcatattccaaaaacataactccaaggcatacgcatgataaaatgcaagaataaacttttggccactttgtggaactcttaaaagaacctttccagccgggcgcagtggctcatgcctgtaatcccagcacaaagtgctgggattacaggtgtgagccaccgtgcccggcctacacaccagctttctattcacctacacacaactgatgctcttttggagtggagagttttagtaaaatatgatggggtcttcaggcacctgagttgctacttactactatgagaagatagaaaatgttttttcctctaaacagcttttgaaagaatgaatgcacaacaaggcaaaaaataaaaactttcttttccttttctacgaaaaatg

SEQ ID NO: 292925 - DNA, 3942 bp, Homo sapiens
gtgaaatcctaagtacagcattattctgggaagcaaaggagacaggcagaagcaaggacaaattaagagaggtaacagtctcatcatgactgatagtcttgttctaacatcttgagaaaagctgtccacagtgtaaagtcatcaacttgtcgtggtttgcagtttgagtgtctctcggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatctccgtcagcaacttcgtgagattacagaaaaaaccagcaagaacaaggatacgctggagaagttacaggcgagcggggatgctctggtggacaggcagagtcaattgaaagaaactttggagaataactctttcctcatcaccactgtaaacaaaaccctccaggcgtataatggctatgtcacgaatctgcagcaagataccagcgtgctccagggcaatctgcagaaccaaatgtattctcataatgtggtcatcatgaacctcaacaacctgaacctgacccaggtgcagcagaggaacctcatcacgaatctgcagcggtctgtggatgacacaagccaggctatccagcgaatcaagaacgactttcaaaatctgcagcaggtttttcttcaagccaagaaggacacggattggctgaaggagaaagtgcagagcttgcagacgctggctgccaacaactctgcgttggccaaagccaacaacgacaccctggaggatatgaacagccagctcaactcattcacaggtcagatggagaacatcaccactatctctcaagccaacgagcagaacctgaaagacctgcaggacttacacaaagatgcagagaatagaacagccatcaagttcaaccaactggaggaacgcttccagctctttgagacggatattgtgaacatcattagcaatatcagttacacagcccaccacctgcggacgctgaccagcaatctaaatgaagtcaggaccacttgcacagatacccttaccaaacacacagatgatctgacctccttgaataataccctggccaacatccgtttggattctgtttctctcaggatgcaacaagatttgatgaggtcgaggttagacactgaagtagccaacttatcagtgattatggaagaaatgaagctagtagactccaagcatggtcagctcatcaagaattttacaatactacaaggtccaccgggccccaggggtccaagaggtgacagaggatcccagggaccccctggcccaactggcaacaagggacagaaaggagagaagggggagcctggaccacctggccctgcgggtgagagaggcccaattggaccagctggtccccccggagagcgtggcggcaaaggatctaaaggctcccagggccccaaaggctcccgtggttcccctgggaagcccggccctcagggccccagtggggacccaggccccccgggcccaccaggcaaagagggactccccggccctcagggccctcctggcttccagggacttcagggcaccgttggggagcctggggtgcctggacctcggggactgccaggcttgcctggggtaccaggcatgccaggccccaagggcccccccggccctcctggcccatcaggagcggtggtgcccctggccctgcagaatgagccaaccccggcaccggaggacaatggctgcccgcctcactggaagaacttcacagacaaatgctactatttttcagttgagaaagaaatttttgaggatgcaaagcttttctgtgaagacaagtcttcacatcttgttttcataaacactagagaggaacagcaatggataaaaaaacagatggtagggagagagagccactggatcggcctcacagactcagagcgtgaaaatgaatggaagtggctggatgggacatctccagactacaaaaattggaaagctggacagccggataactggggtcatggccatgggccaggagaagactgtgctgggttgatttatgctgggcagtggaacgatttccaatgtgaagacgtcaataacttcatttgcgaaaaagacagggagacagtactgtcatctgcattataacggactgtgatgggatcacatgagcaaattttcagctctcaaaggcaaaggacactcctttctaattgcatcaccttctcatcagattgaaaaaaaaaaagcactgaaaaccaattactgaaaaaaaattgacagctagtgttttttaccatccgtcattacccaaagacttgggaactaaaatgttccccagggtgatatgctgattttcattgtgcacatggactgaatcacatagattctcctccgtcagtaaccgtgcgattatacaaattatgtcttccaaagtatggaacactccaatcagaaaaaggttatcattggtcgttgagttatgggaagaacttaagcatatactgtgtaaacagtgccatacatttctaaaatcccaagtgtaggaaaaatatgcagacatacagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtatatatatatatatatatatatttttttttttttttaatgtttcatttcctcagaggaaccaatcacttggaatgtctagaaatatccttgcagattttgccagtgtcaatcaagcctgcacacatgcacagtgaagcgggctgtgctgccttgagcccatcaccagccaacattcttgatgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtaggcgtcacatcagccaaaggcagagatgctagaaagatgggaaccggctacgtgttacctggaaagtttgttttcttaagtcatattccaaaaacataactccaaggcatacgcatgataaaatgcaagaataaacttttggccactttgtggaactcttaaaagaacctttccagccgggcgcagtggctcatgcctgtaatcccagcactttgggaggccgaggcaggcagatgacttgaggtcaggagttcgagaccagcctggccaacgtggcaaaaccccatctctactaaaaataagaaaattagccgggtgtagtggcacatgcctgtaatcccagctactcaggaggctgaggcaggagaatcgcttgagcccaggaggcagagattgcagtgagccaagatcgcaccactgcactccagcctcggtgacagagcaagactccatctcagaaaa

SEQ ID NO: 292926 - DNA, 1643 bp, Homo sapiens
gtgaaatcctaagtacagcattattctgggaagcaaaggagacaggcagaagcaaggacaaattaagagaggtaacagtctcatcatgactgatagtcttgttctaacatcttgagaaaagctgtccacagtgtaaagtcatcaacttgtcgtggtttgcagtttgagtgtctctcggtcaccatgaaagacgacttcgcagaggaggaggaggtgcaatccttcggttacaagcggtttggtattcaggaaggaacacaatgtaccaaatgtaaaaataactgggcactgaagttttctatcatattattatacattttgtgtgccttgctaacaatcacagtagccattttgggatataaagttgtagagaaaatggacaatgtcacaggtggcatggaaacatctcgccaaacctatgatgacaagctcacagcagtggaaagtgacctgaaaaaattaggtgaccaaactgggaagaaagctatcagcaccaactcagaactctccaccttcagatcagacattctagatatataggccaactattagtaataatatgaaatatacttaaagagcttttaaaactttgtatttttgtacaaaatatttgtcttttacaatttttttcctttttttttttttgtcattttaccgacataatacatggagccaaagaaaacaataatggtactaataaaaactcctagggtttcctgtcagatttaattctacccagtggcaaagaattttttcaattgtggctttaaaaaaataattaaatatacatgtatatatatatatatatatatatttttttttttttttaatgtttcatttcctcagaggaaccaatcacttggaatgtctagaaatatccttgcagattttgccagtgtcaatcaagcctgcacacatgcacagtgaagcgggctgtgctgccttgagcccatcaccagccaacattcttgatgtgtgcctgaccagacacagaagaaatgggcaactcaagacgtgcttccacttcattttggtggagtcgggaggtgtgggggatggagaggcatctgttgggaagggcactgaatctggcctatctggaaggccctgtgtcatggctgagctatgactgtacttggcatcagatccctacagagccaacattaactgtcaggaacgtaggcgtcacatcagccaaaggcagagatgctagaaagatgggaaccggctacgtgttacctggaaagtttgttttcttaagtcatattccaaaaacataactccaaggcatacgcatgataaaatgcaagaataaacttttggccactttgtggaactcttaaaagaacctttccagccgggcgcagtggctcatgcctgtaatcccagcactttgggaggccgaggcaggcagatgacttgaggtcaggagttcgagaccagcctggccaacgtggcaaaaccccatctctactaaaaataagaaaattagccgggtgtagtggcacatgcctgtaatcccagctactcaggaggctgaggcaggagaatcgcttgagcccaggaggcagagattgcagtgagccaagatcgcaccactgcactccagcctcggtgacagagcaagactccatctcagaaaa

SEQ ID NO: 292927 - DNA, 7851 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccagtagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtcccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaaaaaaaaaaaa

SEQ ID NO: 292928 - DNA, 662 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgaatctcttgtttggaaatttcctcccagaatacccaacctctcaagaattttaaaacgatggagtaaaataatcttcaagctctgattagattacaacatatgaatgctaattttgtttttacaggtttcaacacccaaatttatctgaacttagggcacaataagcagtttaactgttagaaatcttatgagattgagtttgtgcctatcagatgaatacatatttgtatataacatttcaattattgctacatttatgtataatttatccaaaagcgatgttatcca

SEQ ID NO: 292929 - DNA, 472 bp, Homo sapiens
tcatgagaaactcttttggttccatttggagtgaatttcacaaaagtgctttctccagaagaaacattatgaaaatttttgaaaaggatcctaacaatcacatttgcaggttattgaaaactaatcaatcttctatgattaacagatcctgatacagctccagtgatccatggggtggacgttataaacagtacattagttaaagttacctggtcaacagttccaaaggacagagtacatggacgtctgaaaggctatcaggtttttatcatcatggtttttcctcttcttgttgaattggtatctttcctgagaataaagaagaattgatttcagaagaagtcaaagagaatctgcgaccacaatggatatactaaaagattttggttttcattgcagataaatgggtggaatagcgaggtgccgatgaatagcgaggtgccgatgaatagcgaggtgccgatgaatagcg

SEQ ID NO: 292930 - DNA, 6689 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacaacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtcccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaaaaaaaaaaaa

SEQ ID NO: 292931 - DNA, 5699 bp, Homo sapiens
gctcaaatggcttaggaagcaggcagctgcagctgtggggctggccgcccctccaccaggagctcggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaaaggtatcgggaagatatcaggagtaaatcttactcaaaagactcacccagtagaggtatttgagccgggagctgaacatatagttcgcctaatgactaagaattggggcgataacgatagcatttttcaagatgtaattgagacaagagggagagaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtcccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaaaaaaaaaaaa

SEQ ID NO: 292932 - DNA, 4140 bp, Homo sapiens
cgctgtggtcgtctctacacggatcccccgacggtctttatcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagtgacagtgatgaaaagcctctcaaaggaagccttcggtcccttaatagggatatgcagcctactgaaagtgctgacagcttagtcgaatacggagagggagaccatggtctcttcagtgaagatggatcatttattggtgcctacgctggatctaaggagaagggatctgttgaaagcaatggaagttctacagcaacttttccccttcgggcataaacacaacatatgtaagcaacgctactggttcaccccaaccttccatatttatctgttcaaaggagcaagaactttcatataggaatagaaacatgctggccgaagatttcatccagaagtcaacatcctgcaattatgttgaaaagagtagtactttcttcaaaatataaaatgccaagcacttcaggcctatgttttgcttatattgttttcaggtgctcaaaatgcaaaacacaaaacaaatcctgcatttagatacacctcaactaaatccaaagtccccattcagtatattccatatttgcctgattttactattcggtgtgtttgcatagatgttgctacttggtgggtttttctccgtatgcacattggtatacagtctctgagaactggcttggtgactttgcttcactacaggttaaaagaccataagcaaactggttatttaaaatgtaaaaaggaatatgaaagtcttattaaaacacttcattgaaaatatacagtctaaatttattatttaaattttactagcaaaagtcttaggtgaacaatcaactagtatttgttgagctcctatttgcccagagatggtcatatttaaacagaagtatacgtttttcagtttcaacatgaatttttttatttctgtcagttatgacatccacgagcatcactttttgtgtctgttttttttttttttcttggactaaattcaactgcatggaagcggtggtcagaaggttgttttatacgagaacaggcagaaagtgcccattgttcaggattctaatagctacatctacttaatatcttcatttctaaattgactgcttttacctttttctcatgtttatataatggtatgcttgcatatatttcatgaatacattgtacatattatgttaatatttacacaatttaaaatatagatgtgttttattttgaagtgagaaaatgaacattaacaggcatgtttgtacagctagaatatattagtaagatactgtttttcgtcattccagagctacaactaataacacgaggttccaaagctgaagactttgtataaagtatttgggttttgttcttgtattgctttctttcaacagtttcaaaataaaatatcatacaaatattgagggaaatgttttcatatttttcaaaataggtttttattgttgaatgtacatctaccccagcccctcaaaagaaaaactgtttacatagaaattcctacacatacgtttgcgtatatgttattttaaacatctttgtggtgagaattttttccccgatattctccttctgtcaaagtcagaacaaattcagggaatttattttctggcagttgtgctccagtccttttaaaattgtacatgaacatgttttagaaacaatatggaggatgatgcatacatgtcggtcaagttcagcgctcgacattttatggaaagatttttttaaccttaccacgaaatacttaactactgtttaagtgaattgacttatttcactttagtttttgaactgtgattattggtatactgttatatcctcaacttggatttatggtaaccccttttagttcatggagaccaaaatttggggtatttataatagtcagcgcaggaatgcacatggaatatctacttgtccttttgaacctcacgagtcatccagaatgtatagacaggaaaagcatgtcttatttaaaactgtaatttatgggctcaggatctgaccgcagtcccgggagtaagcatttcaaagggggaaggcagtgtggtccctaccctgtgtgaatgtgaggatgtagacatccatcagtgcaactcgagctccatcctcctccgatttctaaggttccagttttctggagggacagtcatcatgttttgatttatctgggagaaaactgtggtgcacagcttgtgaggagggcaaggttgtgacgttcgagcttagttctggtgttattctgtctcctcttctttgtcatcagccaaaacgtggtttttaaagagagtcatgcaggttagaaataatgtcaaaaatatttaggaatttaataacctttaagtcagaaactaaaacaaatactgaaatattagctcttcctacacttcgtgttcccctttagctgcctgaaaatcaagattgctcctactcagatcttctgagtggctaaaacttatggatatgaaaaatgagattgaatgatgactatgctttgctatcattgttacctttcctcaatactatttggcaactactgggactcttcagcacaaaaggaatagatctatgattgaccctgattttaattgtgaaattatatgattcatatattttatgaatcagaataaccttcaaataaaataaatctaagtcggttaaaatggatttcatgattttccctcagaaaatgagtaacggagtcccacggcgtgcaatggtaattataaattggtgatgcttgtttgcaaattgcccactcgtgataagtcaacagccaatatttaaaactttgttcgttactggctttaccctaactttctctagtctactgtcaatatcattttaatgtaattgattgtatatagtctcaagaatggttggtgggcatgagttcctagagaactgtccaagggttgggaaaatccaaattctcttcctggctccagcactgattttgtacataaacattaggcaggttgcttaacctttttatttcaaactctctcaactctaaagtgctaataataatctcagttaccttatctttgtcacagggtgttcttttttatgaagaaaaatttgaaaatgataaaagctaagatgccttctaacttcataagcaaacctttaactaattatgtatctgaaagtcacccccacataccaactcaacttttttcctgtgaacacataaatatatttttatagaaaaacaaatctacataaaataaatctactgtttagtgagcagtatgacttgtacatgccattgaaaattattaatcagaagaaaattaagcagggtctttgctatacaaaagtgttttccactaattttgcatgcgtatttataagaaaaatgtgaatttggtggttttattctatcggtataaaggcatcgatattttagatgcacccgtgtttgtaaaaatgtagagcacaatggaattatgctggaagtctcaaataatatttttttcctattttatactcatggaagagataagctaaagaggggacaataatgagaaatgttggtgtgcttttctaagcatttaaaacataattgccaattgaaaccctaaatatgtttacataccattaagatatgattcatgtaacaatgttaaattaattataatgggattgggtttgttatctgtggtagtatatatcctagtgttcctatagtgaaataagtagggttcagccaaagctttctttgttttgtaccttaaattgttcgattacgtcatcaaaagagatgaaaggtatgtagaacaggttcacgtgattacctttttcttttggcttggattaatattcatagtagaactttataaaacgtgtttgtattgtaggtggtgtttgtattatgcttatgactatgtatggtttgaaaatattttcattatacatgaaattcaactttccaaataaaagttctacttcatgtaaaaaaaaaaaa

SEQ ID NO: 292933 - DNA, 3805 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggaaatatgctggtttatatgatgacatctccactcaaggctggtttattggactgatgtgtgcgattgctcttctcacactactattattaactgtttgctttgtgaagaggaatagaggtggaaagtactcagttaaagaaaaggaagatttgcatccagacccagaaattcagtcagtaaaagatgaaacctttggtgaatacagaataaagaacaataaagagaaagaaagaaagagagaaaa

SEQ ID NO: 292934 - DNA, 3577 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagcctttgaaatccatggagcagaatggaccaggcctagagtacagagtgacctggaagccacagggagccccagtggagtgggaagaagaaacagtcacaaaccacacattgcgggtgatgacgcctgctgtctatgccccttatgatgtcaaggtccaggctatcaatcaactaggatctgggcctgaccctcagtcagtgactctctattctggagaagactatcctgatacagctccagtgatccatggggtggacgttataaacagtacattagttaaagttacctggtcaacagttccaaaggacagagtacatggacgtctgaaaggctatcagataaattggtggaaaacaaaaagtctgttggatggaagaacacatcccaaagaagtgaacattctaagattttcaggacaaagaaactctggaatggttccttccttagatgcctttagtgaatttcatttaacagtcttagcctataactctaaaggagctggtcctgaaagtgagccttatatatttcaaacaccagaaggagtacctgaacagccaacttttctaaaggtcatcaaagttgataaagacactgccactttatcttggggactacctaagaaattaaatggaaacttaactggctatcttttgcaatatcagataataaatgacacctacgagattggagaattaaatgatattaacattacaactccatcaaagcccagctggcacctctcaaacctgaatgcaactaccaagtacaaattctacttgagggcttgcacttcacagggctgtggaaaaccgatcacggaggaaagctccaccttaggagaagggagtaagtacatgaggct

SEQ ID NO: 292935 - DNA, 2184 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaagtatttttatttcactgttactttgcatgaattgtcacatgggttcagtctgtcttcatttgcccaaatggaataataccatttaagttggagtaccagataaagttctttgaaccgttatcaaaattccta

SEQ ID NO: 292936 - DNA, 3059 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtgttccaaaattcccaaaagaaaaaattgaccctcttgaagtggaggagggagatccaattgtcctcccatgcaatcctcccaaaggcctcccacctttacacatttattggatgaatattgaattagaacacatcgaacaagatgaaagagtatacatgagccaaaagggagatctatacttcgcaaacgtggaagaaaaggacagtcgcaatgactactgttgctttgctgcatttccaagattaaggactattgtacagaaaatgccaatgaaactaacagttaacagtttaaagcatgctaatgactcaagttcatccacagaaattggttccaaggcaaattccatcaagcaaagaaaacccaaactgctgttgcctcccactgagagtggcagtgagtcttcaattaccatcctcaaaggggaaatcttgctgcttgagtgttttgctgaaggcttgccaactccacaggttgattggaacaaaattggtggtgacttaccaaaggggagagaagcaaaagaaaattatggcaagactttgaagatagagaatgtctcctaccaggacaaaggaaattatcgctgcacagccagcaatttcttgggaacagccactcacgattttcacgttatagtagaagagcctcctcgctggacaaagaagcctcagagtgctgtgtatagcaccggaagcaatggcatcttgttatgtgaggctgaaggagaacctcaacccacaatcaagtggagagtcaatggctccccagttgacaatcatccatttgctggtgatgttgtcttccccagggaaatcagttttaccaaccttcaaccaaatcatactgctgtgtaccagtgtgaagcctcaaatgtccatggaactatccttgccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttgaattacattgtgaaagcaaatgtgactcacatttgaaacacagtttgaagttgtcctggagtaaagatggagaagcctttgaaattaatggcacagaagatggcaggataattattgatggagctaatttgaccatatctaatgtaactttagaggaccaaggtatttactgctgttcagctcatactgctctagacagtgctgccgatataactcaagtaactgttcttgatgttccggatccaccagaaaaccttcacttgtctgaaagacagaacaggagtgttcggctgacctgggaagctggagctgaccacaacagcaatattagcgagtatattgttgaatttgaaggaaacaaagaagagcctggaaggtgggaggaactgaccagagtccaaggaaagaaaaccacagttatcttacctttggctccatttgtgagataccagttcagggtcatagccgtgaacgaagtagggagaagtcagcctagccagccgtcagaccatcatgaaacaccaccagcagctccagataggaatccacaaaacataagggttcaagcctctcaacccaaggaaatgattataaagtgggagtaattctgaggatggtcttgtgaagaaagcatcatgaacgccttattctagatctggagatggcatccaggattatgaatgtcttgcccatcaccacacaaccagaaatccgcaaagctaggatttatgtatgaggatctttggactccaaacctcactttttcctcctttacatatctcggttaaatgttattaaatagacttcaccatttgaattttgcataaaaatgcccatctacccagataattttaattattctagggtcatttccaaattttttctgtaacagtggggcattttattttctctctactacttggatgtatttaatgaccagtatattg

SEQ ID NO: 292937 - DNA, 954 bp, Homo sapiens
caggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgctgtaaactgcaaaccataatcctgtcttaatactgcaaacaaatcatagtggaactaaggggaacttaatttactgtttccaggttaactaaggtctcagctgtaaaccaaaagtgagaggagacattaagattttcattcttaccgggttgtcttcttcctgaagagcaatggagccgcttttacttggaagaggactaatcgtatatctaatgttcctcctgttaaaattctcaaaagcaattgaaataccatcttcagttcaacaggttccaacaatcataaaacagtcaaaagtccaagttgcctttcccttcgatgagtattttcaaattgaatgtgaagctaaaggaaatccagaaccaacattttcgtggactaaggatggcaaccctttttatttcactgaccatcggataattccatcgaacaattcaggaacattcaggatcccaaacgaggggcacatatctcactttcaagggaaataccgctgctttgcttcaaataaactgggaatcgctatgtcagaagaaatagaatttatagttccaagtaagtactataacgggaatttcattttacaagtgttttagtgaagtgttaaataggagttagattgggttccaatgaaataaagcagttattaactaaatc

SEQ ID NO: 292938 - DNA, 511 bp, Homo sapiens
aaaacagacaccataatattctgctgttttctgtttgtattcgtatgactaggacatagaaaaatttaatttgcatatctttcttccacaaaagtttaaaactgcgtttatgttattttcaaatagatgtccgtccattgatacaaaccaaagatggagaaaattacgctacagtggttgggtacagtgctttcttacattgcgagttctttgcttcacctgaggcagtcgtgtcctggtaagccggtggctcatggttttcttaagagaatgtcaattgtagatttgaccttgtttcttcatccgtcatttgacaggctgtattgtgtctatattgttacatgtacccagtacctctgagacataaggtaacaaacttaccggtccaggaaattagctctactgaaagcattggctagatttctaggattttctcacatagagacatacagagagccacttgtgttcataaagaaaagcagagaattgaagagattacagagacaatttt

SEQ ID NO: 292939 - DNA, 357 bp, Homo sapiens
ttttttgcatgctttccattatatctaaccttgaagcttccaaagatgtgataggtagctggaaatgattctgagcccgattcttcattttgttttctacgggtatacttgaaaaaaattagaatgggaagaaattccagcttgttcacaccttgacttaggtagttactggcaggatgacttaccttcagtccaatagaattcctagcagagcttaatatttctccaacctgattagcatagagcacattaacctaatatgcaagaatcaaatattttaagctccacttgtttattcgaagtttcacagataccatttctttaactttactcaaattcaaagatataattgctgtt

SEQ ID NO: 292940 - DNA, 431 bp, Homo sapiens
tggccccgcccacatgccagggatgctgaccagggagctggagcccggagtgcccccaacaggccatatctgaaagtcatctccatcagggaagaaactgaggttcaggctccccagacacactgggccagcactttcccagggagcaggacgtcagatgaggagactgacgcctggggttcccagaagtatctgcaaattgttggagtttcagcagggaacaagtgttttggacgagggtgtctctgaaatcccttccacctgcaccccgcccccactgcctcctcccagctcgggcctccgggtctccagttgggccctcatgttgctccttcctgagtctgacaagtaagcctcacagctccctccgcctgcctcttcgtgtcactcggccgtgcagagcaacatggagtcctaatgatttccatccc

SEQ ID NO: 292941 - DNA, 1809 bp, Homo sapiens
aagaaagggaagtagggcagtgcatgactggccttaggttttttctttccaagtttattttcttgtgcttcagctactagaaaggtttaattcagggataagtcccaattgagtagttcaagatgatcagagactttgctattttcccctaagttctattccataatctaaaatgttctgtttctagtgccagttcttatgctaagcaggttacgtggaatatatcacttaactcaaaaagccctgttaagccaggactgttatctccatttaacagatgagaaaatggaggtttatggtctgttctcacactgctacgaagaaataccccaaactgggtaattattataaaggaaagaggtttaatggactcagttccgcattgctggtgaggcctcaggacacttatacaatcatggcagaaaaaggagaagcaggcacctttttcacagggcggcaggatgaaaatgactgccagcagtggaaatgccagacgcttataaaaccttcagatctcatgagaccggctcactatcacaggaacagcatggaggaaaccgcccccatgatccagttacctccacctggtcccacccttgacacgtggggattgctacaattcaaggttagatttgggtgaggacacagagccataccatatcagcccagatcaagtagtgacagagtagggatttgaatacaggttatagtcactattgtgttatttcttgacttttgtactattaaaaaactgtagccagtgaggcttctacccttagtacccagaactccttttaggtatagcaattgtttttaggtaaatttatattgagtttaacacctgtgtgattaaagacaactttccaatgtagtatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttattcccttttgaatgagacagtttttaaaagttgatttataaatacaaaaatacattctccaaagatagtatttccaaactgttatatacccatctactcccaacatggatataagttttttaaaaaaatagttgtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtactacctttctagtatttacatacttaaaagtagtaactagaacagttatcactggaactaagaattttccccacagaggtgaacagaccaagaactaaaatttcaggaaacctgtttaatttcttttgtatctttgaaaagttagttttatatctaagatttcttcacataggttataattcatctgtatgttcaagcttttatgtaaaaatatatagtgccttcagttttaacatagtttcacatgttctcagaactgctaaattcagtgctaccagtaaggcttaataagtagttcattgaccctgtaagataggagcactcagctctgtcacaatttgttgttaaacacatcactcaatgtaagtataaaaatatttattgataaaaaataaacttataattcagc

SEQ ID NO: 292942 - DNA, 1755 bp, Homo sapiens
aagaaagggaagtagggcagtgcatgactggccttaggttttttctttccaagtttattttcttgtgcttcagctactagaaaggtttaattcagggataagtcccaattgagtagttcaagatgatcagagactttgctattttcccctaagttctattccataatctaaaatgttctgtttctagtgccagttcttatgctaagcaggttacgtggaatatatcacttaactcaaaaagccctgttaagccaggactgttatctccatttaacagatgagaaaatggaggtttatggtctgttctcacactgctacgaagaaataccccaaactgggtaattattataaaggaaagaggtttaatggactcagttccgcattgctggtgaggcctcaggacacttatacaatcatggcagaaaaaggagaagcaggcacctttttcacagggcggcaggatgaaaatgactgccagcagtggaaatgccagacgcttataaaaccttcagatctcatgagaccggctcactatcacaggaacagcatggaggaaaccgcccccatgatccagttacctccacctggtcccacccttgacacgtggggattgctacaattcaaggttagatttgggtgaggacacagagccataccatatcagcccagatcaagtagtgacagagtagggatttgaatacaggttatagtcactattgtgttatttcttgacttttgtactattaaaaaaaattgtttttaggtaaatttatattgagtttaacacctgtgtgattaaagacaactttccaatgtagtatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttattcccttttgaatgagacagtttttaaaagttgatttataaatacaaaaatacattctccaaagatagtatttccaaactgttatatacccatctactcccaacatggatataagttttttaaaaaaatagttgtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtactacctttctagtatttacatacttaaaagtagtaactagaacagttatcactggaactaagaattttccccacagaggtgaacagaccaagaactaaaatttcaggaaacctgtttaatttcttttgtatctttgaaaagttagttttatatctaagatttcttcacataggttataattcatctgtatgttcaagcttttatgtaaaaatatatagtgccttcagttttaacatagtttcacatgttctcagaactgctaaattcagtgctaccagtaaggcttaataagtagttcattgaccctgtaagataggagcactcagctctgtcacaatttgttgttaaacacatcactcaatgtaagtataaaaatatttattgataaaaaataaacttataattcagc

SEQ ID NO: 292943 - DNA, 364 bp, Homo sapiens
agcagggctgtgttccctaagaaaaagtaaaacctcacatgaataccctgcagacgacccgctgagccaagccttgggactcctcagctttctcttccccttgtgcctccttttccagagccctgtcttgtgcacccctctagggtgcccgccagctgtgaacacgcttgcccaggctctctgcctccatcaagcatcatttgggaatcatattttaaaattcagaaagttctttgtttactctgagaacagatttttcccaaaggagaacctataataatgatgtgtactgtattatctatcctctgaggtcgataggcctaattccataagtttgtctacattaaaattattgggatggcgt

SEQ ID NO: 292944 - DNA, 575 bp, Homo sapiens
tctcaccatttctattcaacattacaccacaggcgattaggcaagaaaaaaaattctaaaatacaaattggaaagaaagaagtaaaacatgtctatttgcagataataggatctcatacatagaaaattcatagggatgtaattaaaaactattaaaaataataaactgggccgggtgtggtggctcacgcctgtaatcccagcactttaggagggtgaggcgggtggatcacctgaggtcgggagttcaagaccagcctggccaacatggtgaaaccccatctctactaaaaatacaaaaattactgggcgtggtggcgggcgcctgtagtcccagctactttggaggctgaggcaggagaatggtgtgaacccgggaggcagagcttgcagtgagttgagattgttccactgcactccatcctgggcgacagagcgagacgccatccataaataaataaataaagtaaagtaaaaaacctattaaattgaggctagagctggagatgtaattggtttttgagaaaccttagtataaagcttgcccttgttgtgtggaagaagccctttgcgct

SEQ ID NO: 292945 - DNA, 2354 bp, Homo sapiens
cccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292946 - DNA, 796 bp, Homo sapiens
aggctggtctcgaactcctgacctcaagagatccgcccacctgggcctctcaaagtgttgggattacaggcatgagccactgtgcccgaccttacatattctttaattttgttcttttccttcacagttgaagcaccattggccagtttatgtacaatgaatactactgaggctgacagtttattacttttgttatgtgtaatgatttccaatttgtctaatttggtttatgactttactagtcctttcatttttatatttggcattcattttactaaaacaagagcaccaaccaacaaaataattaaacacatgcagtaatactgcaaaaaggttgtgacagtgccaaaaaacaatggttgttgtcaaatagcaccaacatatgacaactagaaatgttcttcagtaaattaagtgttaggagatgtgggagtttattaagttgcataaaagtcgaatgtgtgaaagttaagggctacctgaatttagcagggctttttttttccagtagatatatttagatggtccttgatttatggtcacttaatgggtgattctaagagtggtccttacaatgaactaagctgctcacttccctctcactgagttctctacagattattcctcacctcaacttaaatggtgtttgcctctgctaatttctgagaagttagttaaagttatggtgaaaaatattattttctctccatgacatgtaagaacgtatttattttctgcagcatttatgatctgtctgttcttgcatccatagaagggagtttaggcaccaatcact

SEQ ID NO: 292947 - DNA, 356 bp, Homo sapiens
ccagatgtcatttcaagaatgtcttttcttttaagatgctaaagaaaacccttatggcgaggatgacaataagagtccattccccctgcagcccaaaaacaaacgcagttatgcccagaatgtgactgtctggatcaaacccagcggcctgcaggtaacattaccatttatgttgctttccactggggacaggagacatttggggtagggcaggcaggcattttatttgattttcttttcctttgatacttaggtaattcatttacttctaatgtttgtcattatttcccaaaagggatttgagatgccctacagtaaaacatgtatatagcaaaatcattttttacaaaatttag

SEQ ID NO: 292948 - DNA, 2656 bp, Homo sapiens
cccttctgtcgcgcggccttatagttccggctgtggcgcgcggacggaaagtttatgccgacggaaagtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292949 - DNA, 2766 bp, Homo sapiens
cccttctgtcgcgcggccttatagttccggctgtggcgcgcggacggaaagtttatgccgacggaaagtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaaggtaaaaatacatctcccagatgtgattttcagtctggacttttagagatgaaattatatctgagaactggggagggactcccggaggctgacgggaaagccaaagagcagcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292950 - DNA, 2994 bp, Homo sapiens
aggctggtctcgaactcctgacctcaagagatccgcccacctgggcctctcaaagtgttgggattacaggcatgagccactgtgcccgaccttacatattctttaattttgttcttttccttcacagttgaagcaccattggccagtttatgtacaatgaatactactgaggctgacagtttattacttttgttatgtgtaatgatttccaatttgtctaatttggtttatgactttactagtcctttcatttttatatttggcattcattttactaaaacaagagcaccaaccaacaaaataattaaacacatgcagtaatactgcaaaaaggttgtgacagtgccaaaaaacaatggttgttgtcaaatagcaccaacatatgacaactagaaatgttcttcagtaaattaagtgttaggagatgtgggagtttattaagttgcataaaagtcgaatgtgtgaaagttaagggctacctgaatttagcagggctttttttttccagtagatatatttagatggtccttgatttatggtcacttaatgggtgattctaagagtggtccttacaatgaactaagctgctcacttccctctcactgagttctctacagattattcctcacctcaacttaaatggtgtttgcctctgctaatttctgagaagttagttaaagttatggtgaaaaatattattttctctccatgacatgtaagaacgtatttattttctgcagcatttcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292951 - DNA, 2513 bp, Homo sapiens
cccttctgtcgcgcggccttatagttccggctgtggcgcgcggacggaaagtttatgccgacggaaagtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagcatttcttcgtttatagctgtctgtttgcattctgattgggaacactgggatcattttcatcatgccgacagtggtggtaatggatgtatccctttccatgacccgacctgtgtctattgaggggtccgaggaataccagcgaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292952 - DNA, 2211 bp, Homo sapiens
cccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292953 - DNA, 2070 bp, Homo sapiens
cccttctgtcgcgcggccttatagttccggctgtggcgcgcggacggaaagtttatgccgacggaaagtttatgccgacggactgtgtccggcgatgggcacggggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292954 - DNA, 2849 bp, Homo sapiens
  misc_feature (2381)..(2381): n is a, c, g, or t
  misc_feature (2387)..(2387): n is a, c, g, or t
  misc_feature (2399)..(2399): n is a, c, g, or t
  misc_feature (2402)..(2402): n is a, c, g, or t
cccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaatggtttcactatgaaactaaaggtcanaaaaanaaaagaaaaganaanaaaaagaaaaaaagggggggggccggcaaaaaattcccgccgggggggccccagatttagggagttcccgggtttttttggtcacaagggggggccccttaaggggggggggattaaaaaggcggggagccgggggcgggccgttttaaacaacccggcctgttgtgatggtgggaacaacccgtgccccgtcgcggggagcatctcttggcgggggaggggaaccctatattgcgcgggggcgggggcaccattcttgggcgcgaccacatccctccacggagagattttttaaggctcgaggagggggaaaacatcttcaacatcttggaggcgcttctccgggtgtggtgctcaacccacgacgggcggataatagtctgccggttctgggaaaagatttgggctcaacaggaaggtatgtcctctgacaaatattttttgcga

SEQ ID NO: 292955 - DNA, 1168 bp, Homo sapiens
aagagcaggatgagcagagggattctatgcttgaagtcgagtcacttgaaaaagatctctttgaatgtggaagagatctgagcagatgaaaataaaatcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292956 - DNA, 1604 bp, Homo sapiens
ctttgtatccctggtattctgaatttcagaatgttggtctcttcattgattttgctaggcactcagtggaccctttccatctggcaattcatgatcttcagtactgggaagatcaattatttctttgatttcctctttctgtattctctgttctccttttctggaacatatatttgtgatttgtgtttgtaattttctatctctttctgcccattttcccatttttaaaatttttgttctgtcttctgtatcttcaaatttatcttataacttttattttttgtttatactatctttttaaaatttcttctttcataaatgtaatatttcctgtctcctaagccagttagttaccacatataggctccagacaactaatgacagtacaaaataggctctgattagatgttgaaatgtttggtactgatactaagtgctaggggataaaagggtctacaaaaaccactatctgccagaaaaacttgaaacaatttcatggaaggggtaagataggatctggacttggaatataggtagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292957 - DNA, 2824 bp, Homo sapiens
  misc_feature (2356)..(2356): n is a, c, g, or t
  misc_feature (2362)..(2362): n is a, c, g, or t
  misc_feature (2374)..(2374): n is a, c, g, or t
  misc_feature (2377)..(2377): n is a, c, g, or t
cccttctgtcgcgcggccttatagttccggctgtggcgcgcggacggaaagtttatgccgacggaaagtttatgccgacggactgtgtccggcgatgggcacgggcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggaagcactaagtaatatggatgattatgacaaaacctgcttggagtctgcattagttggtgtttgcaatatcgttcagcaagaatggggtggtgcaattccttgccaggttgtcctggtgacagacggctgtcttggcattggtagagggtcactgcgacattccctagccactcaaaatcaacgaagtgagagcaacaggtttccactaccttttcctttcccatctaagttatatatcatgtgcatggcgaatttggaggagctccagagcaccgattccttggaatgccttgaacgtctcatagatttaaacaatggtgaagggcagatttttactattgatggccccctgtgcttgaagaatgtacagtctatgtttggaaaactgatagatttggcatatacgcctttccatgctgttctcaagtgtggccacctaactgctgatgtacaagtcttccccaggccagaaccttttgttgtagatgaagaaattgatcctatccctaaagtcattaacacagatttggaaatagtgggatttattgatatagctgatatttcaagtcccccagttctgtccagacatctggtcttacctatagcacttaacaaagaaggtgatgaggtgggtactggcatcactgatgacaatgaagatgaaaattcagccaatcagattgcaggcaaaatacccaacttttgtgtcctgctccatggtagcctaaaagtggaaggaatggtagcgattgttcaattaggtcctgaatggcatggaatgctctactcccaagctgacagcaagaagaaatcaaacctcatgatgtctctctttgagcctggcccagaacctctcccatggctagggaaaatggcacagttgggtcctatttcagatgctaaagaaaacccttatggcgaggatgacaataagagtccattccccctgcagcccaaaaacaaacgcagttatgcccagaatgtgactgtctggatcaaacccagcggcctgcagacagatgtacagaagattttaagaaatgcaaggaaactacctgaaaaaacacagacattctataaggagctgaaccgtttgcgaaaggccgctctagcctttggtttcctggacctgctgaaaggggtggctgacatgctggaaagggaatgcacactgctgcctgagacagcccaccctgatgctgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaaanaaaaanaaaagaaaaganaanaaaaagaaaaaaagggggggggccggcaaaaaattcccgccgggggggccccagatttagggagttcccgggtttttttggtcacaagggggggccccttaaggggggggggattaaaaaggcggggagccgggggcgggccgttttaaacaacccggcctgttgtgatggtgggaacaacccgtgccccgtcgcggggagcatctcttggcgggggaggggaaccctatattgcgcgggggcgggggcaccattcttgggcgcgaccacatccctccacggagagattttttaaggctcgaggagggggaaaacatcttcaacatcttggaggcgcttctccgggtgtggtgctcaacccacgacgggcggataatagtctgccggttctgggaaaagatttgggctcaacaggaaggtatgtcctctgacaaatattttttgcga

SEQ ID NO: 292958 - DNA, 945 bp, Homo sapiens
attttcatctctttaaacatttagatccattcttttatattatttcccttttttaccacagaattctaatgttggatttttttttttacccttaatagacagatgtacagaagattttaagaaatgcaaggaaactacctgaatttggtttcctggacctgctgaaaggggtggctgacatgtgcattccagctgacccatgctgcccagcagctcaagctggccagtaccggcacctctgagtatgccgcttatgaccagaacatcacacctttgcacacggacttctctgggagcagcactgaaagaatttgaaactgacttttggagctttccttcttttttcatttcaactgaaaatgctttaggtaaaaacctttccagtatgttcacctctagaatagccacccaaagaccttcctgaggctgcctcagaagcaccacttgctgttttgaatgactctactagtatgagaaggatgtgaaggtggttggctggttgggctttaacttcctgggattcataatttttaagcttggaagatagctgctgttcccatgatgggcacatttcctgagaagcttgaatgactgatgagcatagagcacccctgccttcctcaggaaacctgaccggcaggggctctctggcttcctgaaagcttcacctcttccctcgtttatatctcaactgtaagggcattttcaagcttctgttcatggaatgagcaactcagactgtctggagcttgctgagtacaaacacaccaccactaagtttcagaactttccttagaacttgggcaaaatgtggtggtaactcttaagtgcttttggtatctcttgagattctaacttttaaagagcaaccattaatgtgtaaaatgattcctattattcaaggtttttttttaatgaaaataaaatatttgattttctagaaaa

SEQ ID NO: 292959 - DNA, 1007 bp, Homo sapiens
cccttctgtcgcgcggccttatagttccggctgtggcgcgcggacggaaagtttatgccgacggaaagtttatgccgacggactgtgtccggcgatgggcacggggtgagtggggaggccgagggcccgggactgcctttcgctgcttgttggggttacaggtgaaggggttatgggtgaagaacaacccagggccagcgcttggccttcccgccaccgtggcggccgccccgcgctgtctgtgaggcgccagttccggggcgctgctcccggcctcccctcgctctgaggctcggggtccccagctccgcgtaaactgcacgatttcgccctctgctcagctcccctctgccccctctttccaagagagacttccagatcccacattttcttgactgatttttaagcatttcttcgtttatagctgtctgtttgcattctgattgggaacactgggatcattttcatcatgccgacagtggtggtaatggatgtatccctttccatgacccgacctgtgtctattgaggggtccgaggaataccagcgtaagcacctagcagcccatggtttaacgatgctgtttgagcacatggccacaaattacaagcttgaatttacagcacttgtggttttttcatcactttgggagttgatggtccccttcacgagagattataataccctacaggtacaaaatgtagtaagttattgtatgtacagggcctaaatttattgggaggaaaacagtgttataatgcgttgaatatttagaactttggcattatttaataagtctatgagtacttaatatgtgtaactaaacagcaagaattcacaaccagtaggtcttatgcctactgtttcttcggtacagctatgagttacagctgtgagttgttcccttattttcctctcttggttttctggaattctctgtggaaaagtgagcatctcaggatgtagtgttccattccctaaaatttaggatctttaggctcaacact

SEQ ID NO: 292960 - DNA, 3561 bp, Homo sapiens
gctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgcccagtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatttcaaggatgaggccccagcatggaggattgggggtagaattccacccttgaaccccagcaaacagtccctcccctgactcccaccttggtagggtgctgcctcagggagccataaaagtcggctgtgttttgagacggcgacagaacctgacccgtggagactgggagagcccagcaggcacctgtattgcagggctccgactgcatgtggcaggggctcctgctgcgtctgggcctgaaggtctctctcccagtgctctgtccccagtgttcctagcagaggtatgcttaccagctgtcagcacaaaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcactgggttcttcaggaccttctatatccctcctcggtgaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggtgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaagcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggcctggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaa

SEQ ID NO: 292961 - DNA, 3413 bp, Homo sapiens
gctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgtaaaaacaggccagtgtgtggtgttcaatgggacccacaggacctgtgagatctggagttggtgcccagtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatttcaaggatgaggccccagcatggaggattgggggtagaattccacccttgaaccccagcaaacagtccctcccctgactcccaccttggtagggtgctgcctcagggagccataaaagtcggctgtgttttgagacggcgacagaacctgacccgtggagactgggagagcccagcaggcacctgtattgcagggctccgactgcatgtggcaggggctcctgctgcgtctgggcctgaaggtctctctcccagtgctctgtccccagtgttcctagcagaggtatgcttaccagctgtcagcacaaaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcactgggttcttcaggaccttctatatccctcctcggtgaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggtgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaagcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggcctggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaa

SEQ ID NO: 292962 - DNA, 3335 bp, Homo sapiens
gctgcagctgccatgctgactcatgtgcccgcagctagcaggagctggcagcatgggctccccaggggctacgacaggctgggggcttctggattataagacggagaagtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgtaaaaacaggccagtgtgtggtgttcaatgggacccacaggacctgtgagatctggagttggtgcccagtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatttcaaggatgaggccccagcatggaggattgggggtagaattccacccttgaaccccagcaaacagtccctcccctgactcccaccttggtagggtgctgcctcagggagccataaaagtcggctgtgttttgagacggcgacagaacctgacccgtggagactgggagagcccagcaggcacctgtattgcagggctccgactgcatgtggcaggggctcctgctgcgtctgggcctgaaggtctctctcccagtgctctgtccccagtgttcctagcagaggtatgcttaccagctgtcagcacaaaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcactgggttcttcaggaccttctatatccctcctcggtgaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggtgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaagcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggcctggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaa

SEQ ID NO: 292963 - DNA, 640 bp, Homo sapiens
acccacagagttgcgcccctcaacttccaccttggggaacgaggccagatacacattttcaaaaaaaaaaaaaaaaaaagaaaaagtaaaagcttgtagtattctgtcttgctgcctgctatttgatgttttacctgtgcattttcaatgttagctttgaggtctggtatcattcatattagagtggtttgggacctccagtgatttcctagaagagtgtgtttcctgttggattctttaggagatcccatctggtagatttttagagaactcgatggaaaaatgttctctttagttcatctcagcagacatatttagggaaaacagcaaagcaagcaggagaacaaagggaaaaattcaccaattcctcaatataaccattgttcaaaggaaataactcagattagcatataaaataatcattaggcttttactatccaatatttcttcaggttaccatgtaattacaattatggcatcagcttgaagtttatcatgtatgattgaccactgtgtttactttagctaaccttcagttttgtggtttaactttttaatgtgttagaattttttctttctttttttctttctttctttcttttctttctttctttcttttccttcctttcttccttccttc

SEQ ID NO: 292964 - DNA, 330 bp, Homo sapiens
agacactacaggtagctcttcatcactcagccttccctgaccaccattcaccaattcctcaatataaccattgttcaaaggaaataactcagattagcatataaaataatcattaggcttttactatccaatatttcttcaggttaccatgtaattacaattatggcatcagcttgaagtttatcatgtatgattgaccactgtgtttactttagctaaccttcagttttgtggtttaactttttaatgtgttagaattttttctttctttttttctttctttctttcttttctttctttctttcttttccttcctttcttccttccttc

SEQ ID NO: 292965 - DNA, 432 bp, Homo sapiens
ggcagaggttacggtgagacaagatcgccccattgcactccagcctgggcaacaagagcgaaactccatcttaaaaaaaaaaaatctaactgaggtgcatttttagtaaattactacattgagagaaacaaaattcatccttaaccaactataaactgccaattaacatctaattacataaccaggaaattttcacctttattttacaaattaagaaactatgtatctgaacctaaccaattactgaatttggttttcttcatcatgctgtttataaaagtctttacttcaagccccgcccataaaccataaattacaaaccacagctgggtgctccacaatttttgaatcacgctttgattaaatgctttagtgttttaacggtgactcccatacattttcaacagaagaggaactggaaccccacggacc

SEQ ID NO: 292966 - DNA, 504 bp, Homo sapiens
gtctccagagagacagcctgtgtcttactcagatcccttattaaaatcctgacatccctgggtcttattaaggacctagagaagtgcctggaactcggttcagcacaggtgtgaggcctgatttcctcttgtgatcaactcacagtgtgctggcaagacctgccaatccactcctctgggagcccatctgtcactatgcggaggtgtcactacaagaaaatggtcagggtcactttgctgttgtcttcatatggctgcaagtcttttctttagtgagtgcaagaagacttgattcagtctaccctgaaatagggtctttggttcttttgtcttcaattttgctgttcaagaattttttatttcaaattgcaacttccttggattttgcagatacatatatcatcttttttttttactagctatagtagagaaatgaaaacagtttaataaatgaagaaaaggaaagtatgaatatttgaagaaatagatttggcagttaaatac

SEQ ID NO: 292967 - DNA, 915 bp, Homo sapiens
cgccgctgccgctgcccccggcccgctcgctcgctcgccgcgcgctctcttcctcttacaaactttcgggttctgcagtcgacaagaaaccggggcgaccctcagcaagtcttccccgtgcaggctggggggaactgaaggggacgggacggagacggggtttctccatgttggccagaatggtcttgaactccagacctccagtgatttgcctgcctcggccttccaaagtgctgggattacatgcgtgagccaccacgcccgcctcctgtccacaatctaactgtcaaacaaagatgggctaattaaacggatgccaactaatcggaaaacttctggaattgccgtccctggaaatcctagcaagacacaggacccagaatcctccccattaatattgacgctgtagtgaccaatcaccattaagaggtgccagaaaggaactggaactggcaagtagtcaggtctttcagcggcacccccagaaatcctgtcctataaatggtacttcactctaatgcaaactttgctaaatgttttaaccttgttgtgtaacgcgggggtaaaaagagtacttgatagggttaacacatataatgcatttagaagagcaattcgcaggtggttaacatctgtaacatttgctattattattattggtagtaaaaattatctagcatctgtaaacacttgctattattattgatactaaaagttatccatgagctttttttcttcttcttcttactatgcaaagttgggattctgaagtgaacagctgcacggtgttatcatctttctacacattcacacataacaatcttaatgatatatcacaatgaataatttgacgttatttagctctccttactctgagctgtggactgcatcaaacccaactcgaatagcgttcct

SEQ ID NO: 292968 - DNA, 431 bp, Homo sapiens
cgccgctgccgctgcccccggcccgctcgctcgctcgccgcgcgctctcttcctcttacaaactttcgggttctgcagtcgacaagaaaccggggcgaccctcagcaagtcttccccgtgcaggctggggggaactgaaggggacgggacgggtgagtaggccgaggggccaggacagagagggcagcgggctccgaggacccgcgagtgcgcgtggagggaagagaggatgcggctcagggaatccctgcaaggatccagagaccgggaaatcggcccgagccaaagtctcagcaccttccccaggatctcacaaagttgcaacaacaaaaaggaggggggaggaatagggagaagggggtgggatggggatacgatcacgggcgcaaggtttggagttacaactgtttatttagtccttattctcacag

SEQ ID NO: 292969 - DNA, 5892 bp, Homo sapiens
  misc_feature (508)..(508): n is a, c, g, or t
ggcgaggatggggagcaatgcaaagactctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgntttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgaaccacaactatgggaatgcagttacagggggcggaatggatgcccctcaggcctcgccaatctccccccacttccctcaagatacacgggatggtctgggcttgcctgttggctccaaaaaccttggccaaatggatacctcgaggcagggagggtggggaagtcatgcagggcctggaaaccatgtccagctacgtggaaacctggccaactcaaacatgatgtggggggcaccagcccaggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaggaaggagagaaggtcctgccgcctcagccccagccaccactgccgcctccgcctccgcctccgccgccaccacagctccctcccgaggcagaaagcctcacgcctatggtcatgcccgtgtctgtccctgtcaagcttctcccgcccaagcccagctctcaggggttcaccaacagcaccgttgccgccccctccgccagagacaagccagccagctcgatgtcggacgacgagatgcctgtgctcgaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcattggggggaactggctgtgagccacagcagccccacacagacagtggtctctgaacttcaggaaagccatggacagaaaaaaaa

SEQ ID NO: 292970 - DNA, 548 bp, Homo sapiens
cactaacacatgcacacacagagcactatcatttgcaccaaagcacaaagcctaggactgtgcagaagagccacctcttactgtcttaagactgtgctccctgacccagccctgtatcccttggaatgggagagtgacatagaggggcagggagaacatgcagcccactccatctcaggatgagttgtacagaatgcacactccggaatcaggaagccaccaaatcctatgacagagcagcagtcttaaaaaccaccaggaatcagcagggagaaggtctccttcccccacgaggtttggggatctctcctaacagatgggccaggaagttacatcaccagtggagttgcatctggcaagcaatttggaaacatgaagggacatgcttctcagaaatcgacaggcctgggaactgaacactgcttttggggccagaaatcaggttcggacaagtggacctccctagaaagaaaactgtttaacaaagcactagccacttacagcaaagactttatttttgtacagaagatggtaagcatgatttttcc

SEQ ID NO: 292971 - DNA, 5446 bp, Homo sapiens
  misc_feature (558)..(558): n is a, c, g, or t
ggcgaggatggggagcaatgcaaagactctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggtcgcttctcgggagttcttggtgttggaatattttacagcaaagcagtcgaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgntttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcattggggggaactggctgtgagccacagcagccccacacagacagtggtctctgaacttcaggaaagccatggacagaaaaaaaa

SEQ ID NO: 292972 - DNA, 5482 bp, Homo sapiens
  misc_feature (558)..(558): n is a, c, g, or t
ggcgaggatggggagcaatgcaaagactctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggtcgcttctcgggagttcttggtgttggaatattttacagcaaagcagtcgaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttgntttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctctaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggccggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgactgtagatgtcatgtcactccctttcttccccaggtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcattggggggaactggctgtgagccacagcagccccacacagacagtggtctctgaacttcaggaaagccatggacagaaaaaaaa

SEQ ID NO: 292973 - DNA, 2496 bp, Homo sapiens
ctcttgcttttattaccttaacactagacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttcccatcaagcgttactttgattctgttctgacctcattccatagtttgcagtgagcatggcatctttgcctggagatactatgctaggggcagctttccaggggcaaagcaagccctcgtgttacacggctctcctccagctcacacgacatgtgaggagatgaccaaatgtgaaaacaggtttcccctgtgttgcccgtcatcctttggcccgttcacaggaatggagtactgtataattttaggctttcattcccagcagtgtttactgaggacctggttttctagaacaggtgtgtcctgtcctcttccatgttccctgggggctggtcagctccaagttgtgggtggcagagctgtgtttcagcatgaactgactagagacccatctggaggcaaatattaagttgccaggactgctttcacttcagggtgattgaaggacacatattgaagtacctagaatgccagaaagtgttctattgcccaaaaaacaaatcagaaaagcctattcttttttgcaacgctgttaatgattagtggagttctgaaattactttgtgccacttggaagtactgtgaaaccgcattcactgggattttgctgtaattcacatccgctggactgaagtttaccttgatgttagctataagaaatagttttctaacacatacgatagcaaatacaagacaaatagcattgaaggccaacaaaaatggcttcagatacaccttagctataatgtttgcattcaaacaatgaatgtattcatcacaagtcacttaccaaagcacttctagacttctccaacctccatgactttgctctgcttcctcctgtccctgtcagcagggttgctgtttgtacttgaaggtaataaacctgtaatccttcaaaaatgccatttagccccaggcttctgagctgagtcagactgacccatcccaccgttagggcaaaagtcaggctgggacacagcgccagtacagagaggatcctgcttcatgcaactccccttttggagttaatgcagcgtgatttcctgggccggtgttttcaggcatcgcccaccccaggtatgctggttcccagctccacgtaggtgtgcctatcacgctgggccactttgctgacaacattcatagcttgacatgagagagaatatcagcagaagcatgagagtaggacctgacgtctttgactctgcaaaagcatttagcacacactcattggggggaactggctgtgagccacagcagccccacacagacagtggtctctgaacttcaggaaagccatggacagaaaaaaaa

SEQ ID NO: 292974 - DNA, 309 bp, Homo sapiens
ttgccaggagccctgtgtcctgttgcctcctgacgacgggctgcttgcatgttcggttgtgtcactttctagcaatggataacaccggttctgtcctaatcaccacttgtgatctcaaggcctcctagggcagagctatgtctgttgctttggctctgttggcatttgtctgttggcataagctcctgccccttgtgggtgtgccaagacctgggtgacagtggacagtgcctgcacgtgtggcaaggagacgagtgcatgagaccagagagagccacagaaggtacaatcagcagccccctgcttttg

SEQ ID NO: 292975 - DNA, 361 bp, Homo sapiens
ccagtgcccccgcccctgacctccacagtgctaaccgcttttcccctttgggtagatgatctccataggacacacagaccagttgctgactcttgccttttctctcctttgggtctgcaggttgctctggaaatgctgctactgcggaagcctgtcaggttaaaatgtcatcctttagcaaattaccactatgccggtaggttgccaggagccctgtgtcctgttgcctcctgacgacgggctgcttgcatgttcggttgtgtcactttctagcaatggataacaccggttctgtcctaatcaccacttgtgatctcaaggcctcctagggcagagctatgtctgttgctttggctctgtt

SEQ ID NO: 292976 - DNA, 483 bp, Homo sapiens
aaatcaagcatagagaggctaggatctctttctggagcaagaataattgcatagaaatcataccgcttagcagaccattgtgggacagctggcttctcctcaccctgtgtgagaaatgggtaaccctaagttattttgcaccatactccacccagctccctggaaactgtcaaggataactctggcaggagctgggtaggagagaagctctattatggctggttaggtaactgctcatttgctttagtctttttcaacattccttccctgttgactagtgacctctgatttttgtgttttagacagcatcgatggcagcaacgtgacggtcaccccagggcctggagagcagactgtagatgttgaaccgtaaggaaaagtcaattactctttagaacagaagcctcagcttcttgagaagtatagttaatacttttgtagtcagaggattacactgagagagcagttgtagaaattgtagga

SEQ ID NO: 292977 - DNA, 819 bp, Homo sapiens
gcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggggtgctgtgcctaccagacagcctgaatcttcacagagacccacagcggtcaaacaagccaggggaactgcccatgttcagccagtcggagctgaggaccatcgagcagtctttgctggccacgcgcgtaggcagcatcgccgaattgagtgacctggtgtcccgtgcaatgcatcacctgcagcccctcaatgccaagcaccacggcaatggcacccccctgcaccacaagcagggggcactgtactgggagcccgaggccctgtacaccctttgctatttcatgcactgcccacaaatggaatgggaaaaccccaacgtggagccttccaaagtcaacctccaggtggaaagaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgc

SEQ ID NO: 292978 - DNA, 513 bp, Homo sapiens
gcggccgccgcagtcccgccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggtgacctggtgtcccgtgcaatgcatcacctgcagcccctcaatgccaaaggcccttcctcgtgctgccgccgctgatggagtggatccgggtggccgtggcgcacgccggccaccgccgcagcttctccatggacagcgacgacgtccgccaggcggcccggctgctgctgcccggcgtggactgcgagccgcgccagctcagggccgacgactgcttttgtgcatctcgaaagctggatgcggtggccatcgaagccaagtttaagcaggacctgggtttccggatgctgaactgtggacgaacagacctggtgaagcaggcagtgtctctgc

SEQ ID NO: 292979 - DNA, 286 bp, Homo sapiens
ccggcagccgccgccaaccaccaccatcaccaccaccatgcgctccacgaggcgcccaagttcaccgtggagaccctggagcacacggtcaacaacgactcggagatctggggtctcctgcagccctaccagcacctgatctgcgggaagaacgccagcggtaagtgtctgcgcgggtgccactccctctcacctaacctggccaactcttggcgcaagtttgcctcgcgtccccctcccgcgtcttcccagccacgcgctgctgtcccaagccgctgaggaggcg

SEQ ID NO: 292980 - DNA, 276 bp, Homo sapiens
gaaaataaaggaggagctgcgagggaggaagaaaaaaaaggtcaccagaggaagggaggtggtgaaaaggtgcacagggaagttgagtctgttcctggccttgccactgatgtgtgtgaccctggacagtggcagcaattcctttcatgtctccaggcctcagctttctcactcaatccatatgtttccatgggcaaggaaatagaaggcagtgttgaccttggttactgtttctgtgatccagctctaaagctttcctgttcttgtggtgtgagt

SEQ ID NO: 292981 - DNA, 4049 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctacatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctgg

SEQ ID NO: 292982 - DNA, 2859 bp, Homo sapiens
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctgg

SEQ ID NO: 292983 - DNA, 4181 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgctatgtaataatgggaagcatatgtcattccccatatgtgttggagaatgacatttaaataaatagcaaagctgggtgtggtgttgcaccgctatactcccagctgttggggaggctgagacggaaggatcgcttcagcccgggagattgaggctgcggtgagctatgatcgcgccactgcactccaggctgggcaacggagtgagaccctgtcttgaaaataataataggctggtcacggtggctcatgcctgtggtcccagcactttgggaggctgaggtgggtggatcgcctgaggtcgggggtttgagaccggcctggccagcgtggtgaagcctcatctctgctgagaatgcagagatgtgttgggtttggtggtgcatgcctgtgatcctagctgctggggaggctgaggtaggagaattcgcttgagcctgggaggcggaggttgcagtgagccgagatcgtgccattgcactccagcctggatgacaagagtgaaactccatctc

SEQ ID NO: 292984 - DNA, 3933 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctgg

SEQ ID NO: 292985 - DNA, 3686 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctgg

SEQ ID NO: 292986 - DNA, 3744 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctgg

SEQ ID NO: 292987 - DNA, 4533 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctacatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagcgtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgctatgtaataatgggaagcatatgtcattccccatatgtgttggagaatgacatttaaataaatagcaaagctgggtgtggtgttgcaccgctatactcccagctgttggggaggctgagacggaaggatcgcttcagcccgggagattgaggctgcggtgagctatgatcgcgccactgcactccaggctgggcaacggagtgagaccctgtcttgaaaataataataggctggtcacggtggctcatgcctgtggtcccagcactttgggaggctgaggtgggtggatcgcctgaggtcgggggtttgagaccggcctggccagcgtggtgaagcctcatctctgctgagaatgcagagatgtgttgggtttggtggtgcatgcctgtgatcctagctgctggggaggctgaggtaggagaattcgcttgagcctgggaggcggaggttgcagtgagccgagatcgtgccattgcactccagcctggatgacaagagtgaaactccatctc

SEQ ID NO: 292988 - DNA, 4520 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctacatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgctatgtaataatgggaagcatatgtcattccccatatgtgttggagaatgacatttaaataaatagcaaagctgggtgtggtgttgcaccgctatactcccagctgttggggaggctgagacggaaggatcgcttcagcccgggagattgaggctgcggtgagctatgatcgcgccactgcactccaggctgggcaacggagtgagaccctgtcttgaaaataataataggctggtcacggtggctcatgcctgtggtcccagcactttgggaggctgaggtgggtggatcgcctgaggtcgggggtttgagaccggcctggccagcgtggtgaagcctcatctctgctgagaatgcagagatgtgttgggtttggtggtgcatgcctgtgatcctagctgctggggaggctgaggtaggagaattcgcttgagcctgggaggcggaggttgcagtgagccgagatcgtgccattgcactccagcctggatgacaagagtgaaactccatctc

SEQ ID NO: 292989 - DNA, 4580 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctacatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgaacactgggttttttacaaattgaaggcttgtggcaaccctgcatcgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagcgtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgctatgtaataatgggaagcatatgtcattccccatatgtgttggagaatgacatttaaataaatagcaaagctgggtgtggtgttgcaccgctatactcccagctgttggggaggctgagacggaaggatcgcttcagcccgggagattgaggctgcggtgagctatgatcgcgccactgcactccaggctgggcaacggagtgagaccctgtcttgaaaataataataggctggtcacggtggctcatgcctgtggtcccagcactttgggaggctgaggtgggtggatcgcctgaggtcgggggtttgagaccggcctggccagcgtggtgaagcctcatctctgctgagaatgcagagatgtgttgggtttggtggtgcatgcctgtgatcctagctgctggggaggctgaggtaggagaattcgcttgagcctgggaggcggaggttgcagtgagccgagatcgtgccattgcactccagcctggatgacaagagtgaaactccatctc

SEQ ID NO: 292990 - DNA, 3588 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctgg

SEQ ID NO: 292991 - DNA, 3172 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctacatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttctctgcttcaaatttgattacaccgtcagtggttgccattgtaggacctcaactctctatgtttgccagtggtttattttacagcatgtacattgccgttttcatccagcctttcccgtggtccttctacacagcctctgttttcattggaattgctgctgctgtgctttggacagcacaaggaaactgcctgacaatcaattcggatgagcacagcattgggagaaacagtgggattttctgggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacagtctcagagctgctctccatctccacgaccccctccataagatcaccttgtgatctggcaggatagccagacaccttagttaatggactgatggctcc

SEQ ID NO: 292992 - DNA, 1864 bp, Homo sapiens
  misc_feature (21)..(21): n is a, c, g, or t
gtcagctgtgtgagatacgtnatcgcaagggggcacttctgcagtctagcttgttctttggaaatctctacatatattttgcctggcaagggaaaactcagatatcagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtctgcccagaacaatctgacaaaggcagtagatgcttttaaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgctatgtaataatgggaagcatatgtcattccccatatgtgttggagaatgacatttaaataaatagcaaagctgggtgtggtgttgcaccgctatactcccagctgttggggaggctgagacggaaggatcgcttcagcccgggagattgaggctgcggtgagctatgatcgcgccactgcactccaggctgggcaacggagtgagaccctgtcttgaaaataataataggctggtcacggtggctcatgcctgtggtcccagcactttgggaggctgaggtgggtggatcgcctgaggtcgggggtttgagaccggcctggccagcgtggtgaagcctcatctctgctgagaatgcagagatgtgttgggtttggtggtgcatgcctgtgatcctagctgctggggaggctgaggtaggagaattcgcttgagcctgggaggcggaggttgcagtgagccgagatcgtgccattgcactccagcctggatgacaagagtgaaactccatctc

SEQ ID NO: 292993 - DNA, 2512 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgccgagcgcttgcgcgtgccaggtcacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctacatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcggtgagttggaatctgtcctccctcctttgaagtgcccatcataatgcagtccagaaatgaaaataaatgttcattatatctaaaagcgc

SEQ ID NO: 292994 - DNA, 1739 bp, Homo sapiens
atagggcaaatgtagttcatgccttaagcattttaatctgaaagttatatcccaaagtgttcgtttactggcattattgacaaggggtgttttggttgaaggaagttttagaatgtttgttttattaactaaaatctaattaagtactcttaaatttttgtgtttacagaaaagtcttttaagttatgtgtcaccaaggagatgctccttcttagtattacaactgcttatacaggtctggaattaactttcttctctggtgtatatggaacctgtattggtgctacaaataaatttggagcagaagagaaaagccttattggactttctggcagtttcatcggcattggagaaattttaggtggaagcctcttcggcctgctgagcaagaacaatcgttttggtagaaatccagttgtgctgttgggcatcctggtgcacttcatagctttttatctaatatttctcaacatgcctggagatgccccgattgctcctgttaaaggaactgacagcagtgcttacatcaaatccagcaaagaagttgccattctctgcagttttctgttgggccttggagacagctgctttaatacccagctgcttagtatcttgggctttctgtattctgaagacagcgccccagcatttgccatcttcaagtttgttcagtctatttgcgcagccgtggcatttttctacagcaactaccttctccttcactggcaactcctggtcatggtgatatttgggttttttggaacaatttctttcttcactgtggaatgggaagctgccgcctttgtagcccgcggctctgactaccgaagtatctgatctggtgtccgtgaggggacacgtatgacctcagaaacacagctggacacagagcttggtggaagaagtcgcctttgatcttcactatatattgggtgatgttcagtatggaaaatcaagggattaagactgttaaatcagccagagttggtgttcaagtttacagatatgagttatttaaagcaagtagaataagggaaagctgttctgtcaactgtaattgttcaaagatgttgtttttcatttcatctatctcaattcttataatcatgttatagaatgtaaatgttttcttctctctcctgctcttgttggaagatcctgccttgatttagaatactaggccatatgtcatataaatattttttctggatatggagtatgttttgctatgtaataatgggaagcatatgtcattccccatatgtgttggagaatgacatttaaataaatagcaaagctgggtgtggtgttgcaccgctatactcccagctgttggggaggctgagacggaaggatcgcttcagcccgggagattgaggctgcggtgagctatgatcgcgccactgcactccaggctgggcaacggagtgagaccctgtcttgaaaataataataggctggtcacggtggctcatgcctgtggtcccagcactttgggaggctgaggtgggtggatcgcctgaggtcgggggtttgagaccggcctggccagcgtggtgaagcctcatctctgctgagaatgcagagatgtgttgggtttggtggtgcatgcctgtgatcctagctgctggggaggctgaggtaggagaattcgcttgagcctgggaggcggaggttgcagtgagccgagatcgtgccattgcactccagcctggatgacaagagtgaaactccatctc

SEQ ID NO: 292995 - DNA, 1322 bp, Homo sapiens
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcggtgagttggaatctgtcctccctcctttgaagtgcccatcataatgcagtccagaaatgaaaataaatgttcattatatctaaaagcgc

SEQ ID NO: 292996 - DNA, 2278 bp, Homo sapiens
  misc_feature (1296)..(1296): n is a, c, g, or t
ggagaccgcagctttaaagggggaaaatgcagacgttggataaaaacagcaagaaatagtcattttcattaataggtctcaaacagtttacgaaacagccattattatctaagcttcatacacatcctttctgcagacccctctcttcagtattactcccaaaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcgggcgggacgagcaagcacagcggggttaattccaggcagcggggccggccccgcccgcgcgctcccgcccaggccgccattatctcgccgccagacgccatttccccagtcgcgaggcggggtcctccgccccgcgccgcccacaccccggccactcccgggtcgcagacggcggaagctcgcggggtggccggagggtcgcgagacgcggcgtgcacccccgccccgtccgggcccgcaccacgtgcttcgccgcggacctttgtgaggtcgcccgggcctcccgcgcgccccgccccgcctcccgcggtcccctcagccccgtttacctgcggctccggcgtccgtagccaccgcccccgtacctgcggggtggcggtccccggcggctgtggtgtgagtccggggggcggccgtagcgcgccatttgcacccgcagctcgcggccgtccagcacggccccgtccatggcatccatagcgtcctcagcgtcgcgcttgtcgtgaaagcgaacgaaggcgaagccgcgggactccttggtgtagcgatcccgcgggatgtacacgtcgccgacgcgcccgtacttctcgaagacgcgcctcagcgtgtcgggcgaggtgcggtaggtcaggttgtccaccttgagggaggtcataccctccacatcgggaggggggcggccgtagctcatagctctgagtggcggcccggagccccgcgaactggcgccggcttcctcagctctgggcggtgcgacgccgcgcctctcaggcagttgccttccgcgtggggacactgggaaaggccttgccgcagaacagcacggacgggctccgcaggctagcgcacctnagtaacaactgggcgggcagccggcctctgcgcccgtttatatcgctcctcacaaaatggcgcccgcgccacccggaaatgaaaccttctgattggcccaccgcgccccgcttcgtaacgaccctgccgcgcgccccgcccctacccgaagcgcctgcgcacagcccggcgggcgggccaaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcgcaaactgtcatcaggagcttaaataggacagattttcacggcagtggatataccagcatggctattatctatggagtgttcctctgacttccaaattctggatttaaccaacaccgtccccaaggatttggcgtttggcccagttacttggggctttaacagcgtacccccattcaaactttcatctattcgttttgcccaagtgagtttaattttacagcatgtacattgccgttttcatccagcctttccc

SEQ ID NO: 292997 - DNA, 393 bp, Homo sapiens
cgtgatactaattctggaattgtttggtcgatactatcttgtttcttcttttttctccgtagagagtgaccgaagaacagtgtttattgccctaacggtgattagccttgtggggacagttctattctttctcattcggaaaccagattctgaaaatgtcctaggagaagatgagtcttctgatgaccaggacatggaagtcaacgagtaagatgttggaaacattctattttattttaaaatagattttgagtagatctagtctagagattaccaacccgtttagccctaactgatgtccagtactctctgtaggttaccacaggcaagaaaaggaagaaaataaaggaggagctgcgagggaggaagaaaaaaaaggtcaccagaggaagg

SEQ ID NO: 292998 - DNA, 300 bp, Homo sapiens
caccgctccttcctcttcaggagacttggggggactcttcgatcgcgacctggatttggattccctcttggacactgggggaggactcctggaccgagaccgggacctggaccgcgaacgagatctggagaccgacgaggacttggacttggaccttcgtgcggatctggacttggaggtcgaccgagatcgagaacgagtgcgggaccgagacttcgagcggctgtagcgagatcggctgcgagacctggaacggctccgactccgggatcggctgcggcgacgccgcctagggctgcg

SEQ ID NO: 292999 - DNA, 3517 bp, Homo sapiens
  misc_feature (2696)..(2696): n is a, c, g, or t
acactactgtcccgaacttcagctggaacgctagtccaagtcactgtcctaactgcagctagcactgccgaccttgtccgaggagtttccttccgctccctcaactcccactttcccagggaggggagggggccgggggcaccggcgacagttgcggggaaggaagtggaatctcgcctttgggaaagcccgggcggagagctgagggctcgccgtctcaccttggctgacgtccgcgaggactccctctcggagcaaggttcaggtccaagtaccaaggctctgcgggaccaaggggcgggtcctgcccagaaagggcccctcaccccgcgggcggtcagggccgttcttgagggctgccctccggccgcctgactggaaaaccaggcactccaccccctcctctccgggcccccgtcctcccccggagaatacgacctttcggccatgttagccaggagcgaggggcagggctaaggggccggcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293000 - DNA, 2958 bp, Homo sapiens
  misc_feature (2137)..(2137): n is a, c, g, or t
aaatcaggcttagtggaggccgcgattaaatcggccgaggcactcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293001 - DNA, 2948 bp, Homo sapiens
  misc_feature (2127)..(2127): n is a, c, g, or t
tgcaaagaaaatggcgttggtatttggccgaggtcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293002 - DNA, 2965 bp, Homo sapiens
  misc_feature (2144)..(2144): n is a, c, g, or t
aaatgagtcattaggtcgagcggggtggtagtcggccgaggctcgttcagtcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293003 - DNA, 2931 bp, Homo sapiens
  misc_feature (2110)..(2110): n is a, c, g, or t
cgggccttcagctcgtaattacctggaccgttggccttacaatttcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293004 - DNA, 2936 bp, Homo sapiens
  misc_feature (68)..(68): n is a, c, g, or t
  misc_feature (2115)..(2115): n is a, c, g, or t
gcagctgaggcagaagcagagaagtgcagctgctgccagtgagaagtgcgcctgggtgcgcacccagncgcattctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293005 - DNA, 2961 bp, Homo sapiens
  misc_feature (97)..(97): n is a, c, g, or t
  misc_feature (2140)..(2140): n is a, c, g, or t
cacgaaagattacaggcggcactgcgtttaattcaataggtgacctgcgttcatcttaattacatggcagtggctgacaatcaaatggatcctcagncgcattctgccttcaggatcctccgctcccgaggtatatatgccgcaataacagggtctctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293006 - DNA, 1539 bp, Homo sapiens
  misc_feature (1297)..(1297): n is a, c, g, or t
  misc_feature (1373)..(1373): n is a, c, g, or t
  misc_feature (1383)..(1383): n is a, c, g, or t
  misc_feature (1409)..(1409): n is a, c, g, or t
  misc_feature (1421)..(1421): n is a, c, g, or t
  misc_feature (1432)..(1432): n is a, c, g, or t
  misc_feature (1450)..(1450): n is a, c, g, or t
  misc_feature (1474)..(1474): n is a, c, g, or t
  misc_feature (1496)..(1496): n is a, c, g, or t
  misc_feature (1512)..(1512): n is a, c, g, or t
  misc_feature (1535)..(1535): n is a, c, g, or t
acactactgtcccgaacttcagctggaacgctagtccaagtcactgtcctaactgcagctagcactgccgaccttgtccgaggagtttccttccgctccctcaactcccactttcccagggaggggagggggccgggggcaccggcgacagttgcggggaaggaagtggaatctcgcctttgggaaagcccgggcggagagctgagggctcgccgtctcaccttggctgacgtccgcgaggactccctctcggagcaaggttcaggtccaagtaccaaggctctgcgggaccaaggggcgggtcctgcccagaaagggcccctcaccccgcgggcggtcagggccgttcttgagggctgccctccggccgcctgactggaaaaccaggcactccaccccctcctctccgggcccccgtcctcccccggagaatacgacctttcggccatgttagccaggagcgaggggcagggctaaggggccggcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggttttncagcaagaatgcaggttgcagtagacataatgcattccttttgtgtgtgttacatactacattctactcagaagtnggaagccaantgaaacagttaaagaccgcgtttttntacctaggagcntatttgttttntcctctatttcttgtggntttcccctcttttgacttcttggnttatggactttgccacctaccngttttccgttttgaantgggacgtgtgctaggggctttngttt

SEQ ID NO: 293007 - DNA, 2802 bp, Homo sapiens
  misc_feature (1981)..(1981): n is a, c, g, or t
cggagtctccctctgctgtccaggctggagtacagtggtgcgatctcggcccactgcaacctccacctcccaggttccagtgattctctcgcctcagcctcccgagtagccaggactacaggaatgcagcaccacgcccagctaatttttgtatttttagtagagacgcggtttcaccatgttgaccagcctggtctcgaactcctgacctcagcatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293008 - DNA, 3458 bp, Homo sapiens
  misc_feature (1190)..(1190): n is a, c, g, or t
  misc_feature (1194)..(1194): n is a, c, g, or t
  misc_feature (1199)..(1199): n is a, c, g, or t
  misc_feature (1223)..(1223): n is a, c, g, or t
  misc_feature (2637)..(2637): n is a, c, g, or t
acactactgtcccgaacttcagctggaacgctagtccaagtcactgtcctaactgcagctagcactgccgaccttgtccgaggagtttccttccgctccctcaactcccactttcccagggaggggagggggccgggggcaccggcgacagttgcggggaaggaagtggaatctcgcctttgggaaagcccgggcggagagctgagggctcgccgtctcaccttggctgacgtccgcgaggactccctctcggagcaaggttcaggtccaagtaccaaggctctgcgggaccaaggggcgggtcctgcccagaaagggcccctcaccccgcgggcggtcagggccgttcttgagggctgccctccggccgcctgactggaaaaccaggcactccaccccctcctctccgggcccccgtcctcccccggagaatacgacctttcggccatgttagccaggagcgaggggcagggctaaggggccggcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggngggngtgcntgtgctttggactgatgctgactngtacaacattcgagctacagggcaaagcacaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293009 - DNA, 2524 bp, Homo sapiens
  misc_feature (1703)..(1703): n is a, c, g, or t
ggacgcgtgggtcgacccacgcgtcggcctattgtggctgccatcaatggatcctgcctgggaggaggacttgaggttgccatttcatgccaatacagaatagcaacaaaagacagaaaaacagtattaggtacccctgaagttttgctgggggccttaccaggagcaggaggcacacaaaggctgcccaaaatggtgggtgtgcctgctgctttggacatgatgctgactggtagaagcattcgtgcagacagggcaaagaaaatgggactggttgaccaactggtggaacccctgggaccaggactaaaacctccagaggaacggacaatagaatacctagaagaagttgcaattacttttgccaaaggactagctgataagaagatctctccaaagagagacaagggattggtggaaaaattgacagcgtatgccatgactattccatttgtcaggcaacaggtttacaaaaaagtggaagaaaaagtgcgaaagcagactaaaggcctttatcctgcacctctgaaaataattgatgtggtaaagactggaattgagcaagggagtgatgccggttatctctgtgaatctcagaaatttggagagcttgtaatgaccaaagaatcaaaggccttgatgggactctaccatggtcaggtcctgtgcaagaagaataaatttggagctccacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293010 - DNA, 2937 bp, Homo sapiens
  misc_feature (2116)..(2116): n is a, c, g, or t
acactactgtcccgaacttcagctggaacgctagtccaagtcactgtcctaactgcagctagcactgccgaccttgtccgaggagtttccttccgctccctcaactcccactttcccagggaggggagggggccgggggcaccggcgacagttgcggggaaggaagtggaatctcgcctttgggaaagcccgggcggagagctgagggctcgccgtctcaccttggctgacgtccgcgaggactccctctcggagcaaggttcaggtccaagtaccaaggctctgcgggaccaaggggcgggtcctgcccagaaagggcccctcaccccgcgggcggtcagggccgttcttgagggctgccctccggccgcctgactggaaaaccaggcactccaccccctcctctccgggcccccgtcctcccccggagaatacgacctttcggccatgttagccaggagcgaggggcagggctaaggggccggcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggttatatatgccgcaattttacagggtcttctgctttgctgaccagaacccatattaactatggagtcaaaggggatgtggcagttgttcgaattaactctcccaattcaaaggtaaatacactgagtaaagagctacattcagagttctcagaagttatgaatgaaatctgggctagtgatcaaatcagaagtgccgtccttatctcatcaaagccaggctgctttattgcaggtgctgatatcaacatgttagccgcttgcaagacccttcaagaagtaacacagctatcacaagaagcacagagaatagttgagaaacttgaaaagtccacaaagcctattgtggctgccatcaatggatcctgcctgggaggaggacttgaggttgccatttcatgccaatacagaatagcaacaaaagacagaaggatgttaagcatctggctattcttggtgcagggctgatgggagcaggcatcgcccaagtctccgtggataaggggctaaagactatacttaaagatgccaccctcactgcgctagaccgaggacagcaacaagtgttcaaaggattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtgattccagatcactgtatctttgccagtaacacatctgctctcccaatcagtgaaatcgctgctgtcagcaaaagacctgagaaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggatggacctggcttctatactaccaggtgtcttgcgcccatgatgtctgaagtcatccgaatcctccaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtcgtaaatctgggaagggcttttacatctatcaggagggtgtgaagaggaaggatttgaattctgacatggatagtattttagcgagtctgaagctgcctcctaagtctgaagtctcatcagacgaagacatccagttccgcctggtgacaagatttgtgaatgaggcagtcatgtgcctgcaagaggggatctnggccacacctgcagagggagacatcggagccgtctttgggcttggcttcccgccttgtctgggagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagc

SEQ ID NO: 293011 - DNA, 343 bp, Homo sapiens
ccagaacccatattaactatggagtcaaaggggatgtggcagttgttcgaattaactctcccaattcaaaggtatctcatttaatttgcagtttttttctgctaaccgcattatgaatctagtcctgaatgggaaagatgtatcccatatttccccaaatctaccaatctggcagtaatcttacatgaatttacagttttgacagttatgttaaactttgacagattgccaagggagccagttttctaaagcagaggttcttgcgtaagaattcctcttgttgaccttaggtgccaccagcctcctggttatagtgtagaatgaggaggtgacttattagaga

SEQ ID NO: 293012 - DNA, 805 bp, Homo sapiens
cgggacgcgggctcaaggcattgaatcccatggcccggccgggccccggacccttaaaggaccgggcggttcctcctcccgcggcgcgcgcggagcagtttcccctcgccgcttccgggactgcacacgtgcctccgagcaaccacgacaacagctagcctcccgcccgccctcctctcgcagccgcagcccgccttcaaagcggaccaaggcccgcggacggcgcagccaataggctttctggggtttgctctctagctaatgggaagactatctttttacgcccttggccagtaagagagcagatggtggcctcagcgacctatggcaaagtcctttcccacccctaacggaggctctgggagagagaggatgcaggaccaagacccgagaagaagcctgcgtctgggcctgggtgggacggattcaggcgcgcagcaacaacagggtgcctggcacaaggagatactcagtaaaactctcatctgctgtgtcattaaggggaacacttaatggctcacgcctgtaatcccagcactttgggaggccgaggcggaaggatcacctgagcccaggagttggagaccagcctgggcaacagattgagaccctgtctcaacaaagaagaagaagaagaaaaaggccaggcgccgtggctaatgtctgtaatcccagcactttgggaggccaagaagggagaactgcttgaggccaggagttcgagaccagcctggtcaacatagcgagacaccccccccatctcaaaaataaataaatcaaaataaaaaataaagaggaggccggg

SEQ ID NO: 293013 - DNA, 2462 bp, Homo sapiens
  misc_feature (2)..(2): n is a, c, g, or t
  misc_feature (6)..(7): n is a, c, g, or t
  misc_feature (867)..(867): n is a, c, g, or t
  misc_feature (920)..(921): n is a, c, g, or t
  misc_feature (2183)..(2183): n is a, c, g, or t
  misc_feature (2186)..(2188): n is a, c, g, or t
  misc_feature (2198)..(2198): n is a, c, g, or t
  misc_feature (2200)..(2200): n is a, c, g, or t
  misc_feature (2233)..(2233): n is a, c, g, or t
  misc_feature (2235)..(2238): n is a, c, g, or t
  misc_feature (2243)..(2243): n is a, c, g, or t
  misc_feature (2252)..(2252): n is a, c, g, or t
  misc_feature (2260)..(2260): n is a, c, g, or t
  misc_feature (2267)..(2267): n is a, c, g, or t
  misc_feature (2272)..(2272): n is a, c, g, or t
  misc_feature (2277)..(2277): n is a, c, g, or t
  misc_feature (2290)..(2291): n is a, c, g, or t
  misc_feature (2293)..(2293): n is a, c, g, or t
  misc_feature (2304)..(2305): n is a, c, g, or t
  misc_feature (2318)..(2318): n is a, c, g, or t
  misc_feature (2323)..(2323): n is a, c, g, or t
  misc_feature (2325)..(2325): n is a, c, g, or t
  misc_feature (2330)..(2332): n is a, c, g, or t
  misc_feature (2335)..(2335): n is a, c, g, or t
  misc_feature (2337)..(2337): n is a, c, g, or t
  misc_feature (2352)..(2352): n is a, c, g, or t
  misc_feature (2355)..(2355): n is a, c, g, or t
  misc_feature (2363)..(2363): n is a, c, g, or t
  misc_feature (2393)..(2394): n is a, c, g, or t
  misc_feature (2399)..(2399): n is a, c, g, or t
  misc_feature (2402)..(2403): n is a, c, g, or t
  misc_feature (2416)..(2418): n is a, c, g, or t
  misc_feature (2442)..(2442): n is a, c, g, or t
gncacnnggctgaagcgctgccgctgccgctactgccgctgcagggaaaatgctgagccctcccgggccgggtgggcggcggcggcgagggcggcgacggggacccgcttcccgagcgcggcggcggcggccatggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggcacggtggctcacgcctgtaatctcagcactttgggaggccgaggcgggcagctcacgaggtcaggagatcgagaccatcctggctaacacggtgaaatcccatctctactaaanatacaaaaaattagccgggcatggtggcccgtgtctgcagtcccagctactcnngaggctgaggcaggagaatggcgtgaacccaagaggcggagcttgcagtgagctgagatcgcaccactacactccagactgggcgacagagcgagactccatctcaaaaacaataataataataataataatgtaaaacttaagaaagcatgtgacatttaagaataaagaatttaagtagtatttcaaaaaaaaaaaaaaaaaacacctgcgcgccccatctcttcaggtccagcgccgcctacccccatttcgccatttttaccggcgcgcccgccccgaggcgcagaagtagggcgaacggtggccgcagctcctttctcccggctcagccgccggccagcagccgcgccggaacctcggcccacgtgacgcgggcgcgcgcctatggaactgacggtggagttccgcgaagaaggtgccgcagagaattcgcaaacaccaaccgtaaccagagcagctgggggcgcggcggcgagagaagctgcgaagcgcatgcgcgcaggacgctgtgggaggggaaaggaggggaggagcgtggagcgatcgcctagttcccgcgttgcggggcgcatacgagacttggcgactcgctgcctcagggttgcgtgcctccggccctagcctgcgcaggcggcctgagcttggggctctgctacgccacccacgcccaccttggcggagggcggggccccacggctctcaaacttgcgcgccaaagacggagccacctggcgtactggtggaaagcgcagacttcagagccacacccgtagttaagtattcggactctgagattccagggtggggcccaggccatccgcgttttcacccagcatcgtgtgattcggcagcaggtggtctgtggcccgcactttgagaaaccctggtgcagaaggttcatggttagtggttctctctggaaggaacagtctaaggtttgtaggacttgcgttccacctaccaaagctaatcgagttagaaggctccaaactgaggtgtcatttctcattacggtggtgagaggacgggaccacacactgtgaagtcttcgttcccacatcccacacttcattcttgccgcctaagttgtcgccgtgggactattgaaagggtatcagcgatattcatctttcctataaatgggatctgctttctacagtttcctgccagatgtgtaaagattgcaagaattgaaggtatttcttcaactgaagacctttacagatactcagatgactgaaatcctcttatcactggcnggnnntggtggctcncncctgtaatcccagcactttgggaggctgaggcngnnnnatcanctgaggtcnggagttcnagaccancctgnccaanatggtgaaacccnntntctactaaaannacaaaaattagcngggcntngtggnnngcncntgtaatcccagctantcnggaggctnaggcaggagaatcacttgaacccaggaggnngaggntgnngtgagccgagatnnngccattgcactccagcctgggcancaagagtgaaactccatctc

SEQ ID NO: 293014 - DNA, 1842 bp, Homo sapiens
agaaaataaatatatcttacccttcaactaatatgtttctgaatcttagaaaattactatgatattagtattcaatttcttatattctctgtctccctcttctctcatttcctttccccttttcttcccctctgttccttcccccaatcattctcttctctattctatgtctctgaagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggaaccataagtggcagctcttcccgttcaagacccgagtattttagaattactgcctccaacaggatgtattcactctgccggaggtaagtgtgtcagtgggctccaaaaagaggtcttccttcctttcttcttatttgaatctttaataggccatttgcatccatagccctgagatagataaaaatgcctgaaaataagaacaaggtctccaggatacgagcaagcatctcattggcattctcggaacaattaccttactgaaagtacctctagtaggtgagaaggtgaaaggtaaagtactcaccccctatgaatttctcttgtctttctcttcccagtttgcttcttttctagcatgactaaagataacttgaagaacaggattttcccagcccaatagaggacatgaaagtcttttgtaggctggggagccacaaactctttctataaagggtcagttggtaaatattttcagtttatgagccatagagtctcttgttgcagctattcaactgtgccgcaaaagcagccacagacagtaaggaaatgagtaggcatggccagttttggcccacaggctataatttgctgacccaggtgtaggcaaggctttcttatgcggtctaattggaatgttttcaagggaatattacttaaaggatgtaaataaagaggcattttcttttttcagttcttgtcatctctcactgtttttcaaatatgttgagtcttattccatgctttactatatgtaaatatatattttctaaaattacattttcaccatccacaagtttagtcattttcatctccaggtaagatttttctttgcatttataaattcctgcttaaacagctctgaaatcactttgtaaattgtaagctttgtacatattttagaaagttatcttaatgttactttcaaccctgttgctcttgaagatagatatgtcattttaaatggcaatttaagtttacaaatattaatatgaaacttcagaaacaagttgggaatatagttttgagattgtggccaaataaacattttgcatgaagttctgaaaaattggcactctgagtatgcagtaatttttctggaattctccgtcattctaactaaattttctctgaagatgagtcatgttgtcggggtgtgatgtcctgctgtttggaaagtttgctatcaaaattatgccagccattgagaaaacagactcatttatcattccaatctgtcagaagtaaaataaaattttaatagatgacttattagaacactggttataaagcatttatgatggtaaaaagtaatatatatccattaagttattagcaggaaggaaatggaataataaaaaataatccaaaagaaggcaagaaaggaaaaaaaaggggacatagaacaaatggaataaataacaagtagtaagatggtagatttaaattcaaatatatccataattgcattaattattaattgactaaatgttccaattcaaagaaagagatcagggtttgcttt

SEQ ID NO: 293015 - DNA, 5026 bp, Homo sapiens
  misc_feature (2)..(2): n is a, c, g, or t
  misc_feature (6)..(7): n is a, c, g, or t
gncacnnggctgaagcgctgccgctgccgctactgccgctgcagggaaaatgctgagccctcccgggccgggtgggcggcggcggcgagggcggcgacggggacccgcttcccgagcgcggcggcggcggccatggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggaattcaaaatgtcctcagcctcttttgtgcagtcctcacagaaaataaggttctcttccattctgcaagtttccagagacttagtgatgcttgtagagccctggaatctttaatgtttcctcttaaatatagttatccttatatccctattctcccggctcagctactggaagttctaagttccccaacgcctttcattattggagtacattctgtctttaaaactgatgtccatgaacttttagatgtaatcatagcagatttggatggaggcactattaaaattcccgaatgtattcacctctcttccctcccagaaccacttctacatcagactcaatcagctctttctttgattttacacccagatttggaagtagcagatcatgcttttcctcctccacgaacagctttatcccactcaaaaatgctggataaagaggtgcgagccgttttccttagattatttgcacaactcttccaaggatatagatcctgcctgcaacttataagaattcatgcagagccagtaatacatttccacaagacagcattcttggggcagcgtggtttggtcgagaatgatttcctcactaaagtactcagtggaatggcatttgcaggttttgtttcagaaagaggtcctccttatagatcttgtgatctctttgatgagttggtagcctttgaagtagagagaattaaagttgaagaaaataacccagtgaagatgataaagcatgtcagggaacttgctgagcaactattcaaaaatgagaatccaaatcctcatatggcattccagaaagttccacggccaacagaaggatcccatttgcgagttcatattcttcctttcccagagattaatgaagcccgggttcaggaattaatacaggaaaatgttgctaagaaccagaatgcacctcctgccacacgaatagaaaagaaatgtgttgtgccagcaggtccacctgttgtttcgataatggacaaggtgacgacagttttcaacagtgcacaaagactagaagttgtcagaaactgtatctcattcatatttgaaaataaaattttggaaactgaaaagacccttcctgctgcactcagagcccttaaaggaaaggcagcaagacagtgtctcactgatgaattgggtttgcatgtccagcaaaaccgggcaatattagaccatcaacagtttgactacataataaggatgatgaattgtactctacaggattgttcaagtttagaagaatacaacattgccgcagcattactccctttgaccagtgctttctataggaaacttgcccctggagtcagccagtttgcttacacgtgtgtacaagaccaccccatttggacaaatcagcaattttgggagacaaccttttacaatgcagtgcaggaacaggttcgctccctttatctctcagccaaggaagacaatcatgccccgcatctgaagcaaaaggataagcttcctgatgaccattatcaggagaagacagcaatggacctggcagctgagcaactacgcctttggcctaccctgagcaagtcaactcagcaagagctagtgcaacatgaggaaagcactgtctttagtcaggccattcactttgcaaacctcatggtgaacctgctagttccactcgacacaagtaaaaacaagctcctaagaacatcagcgccaggtgactgggagagcggaagcaacagcattgtcacaaacagtattgcaggaagtgtagctgagagctatgatacagagagtgggtttgaagattcagagaatactgacattgccaattctgttgtgcggttcattacccgatttattgacaaagtttgtacagagagtggagttactcaggatcacatcaagagccttcattgcatgataccaggaattgtagctatgcacattgagaccctagaagcagtacatcgagaaagcagaagacttccgcctattcagaagcccaagattcttagacctgctctgctgccaggagaagaaattgtctgtgagggtcttcgagtcttgctggatcctgatggaagagaagaagctactggaggtcttcttggaggccctcagctcctgccagcagaaggagccttgttcctcaccacatacagaattctcttcagaggaacaccccatgatcagttagtgggtgagcagacagttgtgcggagctttcccattgcctccatcaccaaggagaagaagattacaatgcagaaccagctacagcagaacatgcaagaaggactgcagatcacatcagcatcttttcagttgattaaggtagcatttgatgaagaagtcagtccagaagtagtagagatctttaagaaacagctgatgaagttccgttatcctcagtccattttcagtacctttgcttttgctgctggacaaactaccccacaaataattttaccaaaacagaaggaaaagaacacttcttttcgtaccttctcaaaaacaattgtgaaaggtgccaaaagggcagggaaaatgacaattgggcggcaatatttactgaagaagaagacagggacaattgtggaagaaagagtaaatcgtcctggatggaatgaagatgatgatgtatctgtttcagatgagagtgagctccccacaagtaccaccctgaaggcctccgagaagtctacaatggaacagttggtggaaaaagcttgtttcagagactatcagcgtttaggtttaggaaccataagtggcagctcttcccgttcaagacccgagtattttagaattactgcctccaacaggatgtattcactctgccggaggtaagtgtgtcagtgggctccaaaaagaggtcttccttcctttcttcttatttgaatctttaataggccatttgcatccatagccctgagatagataaaaatgcctgaaaataagaacaaggtctccaggatacgagcaagcatctcattggcattctcggaacaattaccttactgaaagtacctctagtaggtgagaaggtgaaaggtaaagtactcaccccctatgaatttctcttgtctttctcttcccagtttgcttcttttctagcatgactaaagataacttgaagaacaggattttcccagcccaatagaggacatgaaagtcttttgtaggctggggagccacaaactctttctataaagggtcagttggtaaatattttcagtttatgagccatagagtctcttgttgcagctattcaactgtgccgcaaaagcagccacagacagtaaggaaatgagtaggcatggccagttttggcccacaggctataatttgctgacccaggtgtaggcaaggctttcttatgcggtctaattggaatgttttcaagggaatattacttaaaggatgtaaataaagaggcattttcttttttcagttcttgtcatctctcactgtttttcaaatatgttgagtcttattccatgctttactatatgtaaatatatattttctaaaattacattttcaccatccacaagtttagtcattttcatctccaggtaagatttttctttgcatttataaattcctgcttaaacagctctgaaatcactttgtaaattgtaagctttgtacatattttagaaagttatcttaatgttactttcaaccctgttgctcttgaagatagatatgtcattttaaatggcaatttaagtttacaaatattaatatgaaacttcagaaacaagttgggaatatagttttgagattgtggccaaataaacattttgcatgaagttctgaaaaattggcactctgagtatgcagtaatttttctggaattctccgtcattctaactaaattttctctgaagatgagtcatgttgtcggggtgtgatgtcctgctgtttggaaagtttgctatcaaaattatgccagccattgagaaaacagactcatttatcattccaatctgtcagaagtaaaataaaattttaatagatgacttattagaacactggttataaagcatttatgatggtaaaaagtaatatatatccattaagttattagcaggaaggaaatggaataataaaaaataatccaaaagaaggcaagaaaggaaaaaaaaggggacatagaacaaatggaataaataacaagtagtaagatggtagatttaaattcaaatatatccataattgcattaattattaattgactaaatgttccaattcaaagaaagagatcagggtttgcttt

SEQ ID NO: 293016 - DNA, 847 bp, Homo sapiens
  misc_feature (2)..(2): n is a, c, g, or t
  misc_feature (6)..(7): n is a, c, g, or t
gncacnnggctgaagcgctgccgctgccgctactgccgctgcagggaaaatgctgagccctcccgggccgggtgggcggcggcggcgagggcggcgacggggacccgcttcccgagcgcggcggcggcggccatggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattggtgttcctagaggaaggtcatatagcagttaaactctgccattttgcctcttactgcacctgcgtgagctcactcacccaactcctgagctcttatcaggaagctgccgatcaccaatttcaggtatttctatc

SEQ ID NO: 293017 - DNA, 866 bp, Homo sapiens
gattattgagtttcagcataaaacctggcaatacatgtcttccattatagttcagccatgctatttatttattttctgattagtttttaaaatgtttttaaattgttgtaaaatacatatataacataaaataatctaagtgtacaattcagtggcattaattacatctacaatgttgtgcagccatcactgttatctatttctaaaacttttttattaccccaaacactctacccattaagcagtaactcctgtttcccctggtaacttctaatgtattttctgtctctataaagttgcctgttctagatatttcacataagtggacttagataatatttgtacttttgggtttggtttatttcatttagtataatgttttcaaggttcatacgtgttgtggcatgtatcagaatttcattcctttttatggctgagtaactttccatggtatggctgtcccacattttatccattcatctgttgatggacatttgagttacttctccctcccttttagctattataaataataatacatgaatatccacatataagtatctgtttgagtcctttcatttcttttgggtatatatgtagaagtggaattgctgggtcataatggtaattctctttaacttttttgaggaaccagtaaactgtaattaacttttaattctaaaatatccagaatttgtttttatcctgcttgtctgtgttctttcattttgaatactctgactcatcctaggaattgtagctatgcacattgagaccctagaagcagtacatcgagaaagcagaagacttccgcctattcagaaggtaattccagactacatgctttcagggtatagcctctcttc

SEQ ID NO: 293018 - DNA, 164 bp, Homo sapiens
ggatccccggaacacacgccttctccagcctgcaatctacacacgtggggaagcgcgtccaagtggtgccaggaggcaggagggaagcgcaaaggttaatgcacaccaagtccacgtcctgatgcagcagcacctcatcaatgcggctagtgtagaaggggaca

SEQ ID NO: 293019 - DNA, 578 bp, Homo sapiens
gccccggcgccgggcttccccccgccttaggaagctcgcccttccagccagcggccccgactgtactggctccgcggcagccttggctcaggcggccagcgctggacagcggccggggaatcccgtgctgcgcggcgcggccgaggggcgggcctggcccggagagtaccgcggcttcggccctctgccgtgcgcctcgcgcgttttgcatcgctgagcgaagcagagacgcccccccttttcggtctccttaactggttcgtcttcgtagttggaattcctttgcatgaggctatggaatatacactaccttctctggacgttaactattagctacagcttgaggactcccaaatttatgcctttagcaacacgatccgagccctgcaacttttcgacctcattttgagccaacattattttgctcccttattttgttgaagtactttctccagttatttacttaaaatgttcacatgagagacatactatttgattccttgcttgtactaagatgtaatgattgtaacgacttcattttcctagacccagataaaagtctcgcttcattcatgaaa

SEQ ID NO: 293020 - DNA, 1034 bp, Homo sapiens
gttgctaggctccgacagccgggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggcaaaatgtactgtggccatgt

SEQ ID NO: 293021 - DNA, 1014 bp, Homo sapiens
gttgctaggctccgacagccgggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293022 - DNA, 841 bp, Homo sapiens
gttgctaggctccgacagccgggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccgcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293023 - DNA, 673 bp, Homo sapiens
acgagaaggaaaaagatgaagatggattcttatatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293024 - DNA, 390 bp, Homo sapiens
gtccgcggcgctactactaccggataaactgcgtctgagataaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293025 - DNA, 1121 bp, Homo sapiens
  misc_feature (1050)..(1052): n is a, c, g, or t
  misc_feature (1058)..(1058): n is a, c, g, or t
  misc_feature (1067)..(1068): n is a, c, g, or t
  misc_feature (1072)..(1072): n is a, c, g, or t
  misc_feature (1076)..(1076): n is a, c, g, or t
  misc_feature (1087)..(1088): n is a, c, g, or t
  misc_feature (1093)..(1093): n is a, c, g, or t
  misc_feature (1097)..(1097): n is a, c, g, or t
  misc_feature (1102)..(1102): n is a, c, g, or t
gttgctaggctccgacagccgggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggccaaaaaaaaaaaaaaaaaaaaaaaacaaaaaaaaannntttggngccgccggnncccngagnaaaaaggtttnnaaacnccanttctnttgggggccgcggggccca

SEQ ID NO: 293026 - DNA, 970 bp, Homo sapiens
ggtgaccagagattcatacgatacattcagcgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293027 - DNA, 762 bp, Homo sapiens
taccccaaagatttttgagcatcaccattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293028 - DNA, 2270 bp, Homo sapiens
acgcccagctaattttttgtattttttagtagagacggggtttcaccgttgttagccaggatggtctcaatctcctgaccttgtgatccacccgcctcggcctcccaaactgctgggattacaggtgtgagccaccgcgcccggcttacttttgtatttttagtagagacagggtttcactatgttggtcaggctggtcttgaactcccgacctcaggtgatccacttaatatattttatttgacccagtatatccataattttatcatttcaacatgtaatcaaaattgagctattttgctgcattttcatactaagtctgaagccttgtttatgttttacactgcacatcccaattcacacgagccagactttcaagtgctgaatgtagctagtggctgctgtggcagtgatacaggacatttcaatcagagcagagatttctattgaacagttctgttccagggagtccttattttacaaattccaggctaagaggtcctcacagggagcaccgtttttattgtacaagatgctgatgacaggttctttcatattcaaattcagacctcccccacattgttacttaataattctcatctacccacacagccatccgagctaagcttgcaaatggggcaggaagaacaggaaaaaaactcaaaacctcccccttcataaatgtggtatttgtccatgtttacatggaggttccactcagcccttgaggagcaaagcagcaagtggggcagtcactgtttcctcaggttgaggccttggactccttatcttccccactggctcttggtttatgagttccccttttaaggatctgttgtgacttacctatctgggctagtgacctcagatgtctcagactgagcatcttaccactgtttctggttgatcccttcactcatggtcttaacacatttgcacttcctctcatctcagagagtacagtcacggggcagagcttgcatagggatccaggtgttactagtcttactctggagctggtccaactcagttcatggcacagaactagataggtctccctgcgcatctgtttactgcttagggaagccagcttttctacccacacacgttttagtttgaagagtatctatttttggagggttctttgggagttgggcaggcttctttggatcccagatacatttagagctttttgcattaagtgtgaggaaaataacttctctttgatgatgttgatacaccatgtgggcaccctggggcacaggggtttagctggggagattccatgagaatgaacccaaactactcttctttgctagggtcctttacccacacagaggtgagcctttcaggttcttcattttgcttagtttcttcccttgtccttggcatttaagaggcatccatgtgttagccagccaaagccccctgaaggagctggctgctttaaaggatttacttgggaggatgtcaaatggctttgccttctgcagacttcatttattttaatctttttatggctcctttctcttgctttaaaacaggattataagcacacagcaggtactgacacctgaagtcttactaaattcctgtcctcaggccatcctttttctcctgaaacctggactccaattttcaatgacgtttttgtttttctctttcaagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293029 - DNA, 1138 bp, Homo sapiens
gttgctaggctccgacagccgggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccaggattataagcacacagcaggtactgacacctgaagtcttactaaattcctgtcctcaggccatcctttttctcctgaaacctggactccaattttcaatgacgtttttgtttttctctttcaagcctaactatgggacagctttacgagaaggaaaaagatgaagatggattcttatatgtggcctacagcggagagaacacttttggcttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293030 - DNA, 2216 bp, Homo sapiens
acgcccagctaattttttgtattttttagtagagacggggtttcaccgttgttagccaggatggtctcaatctcctgaccttgtgatccacccgcctcggcctcccaaactgctgggattacaggtgtgagccaccgcgcccggcttacttttgtatttttagtagagacagggtttcactatgttggtcaggctggtcttgaactcccgacctcaggtgatccacttaatatattttatttgacccagtatatccataattttatcatttcaacatgtaatcaaaattgagctattttgctgcattttcatactaagtctgaagccttgtttatgttttacactgcacatcccaattcacacgagccagactttcaagtgctgaatgtagctagtggctgctgtggcagtgatacaggacatttcaatcagagcagagatttctattgaacagttctgttccagggagtccttattttacaaattccaggctaagaggtcctcacagggagcaccgtttttattgtacaagatgctgatgacaggttctttcatattcaaattcagacctcccccacattgttacttaataattctcatctacccacacagccatccgagctaagcttgcaaatggggcaggaagaacaggaaaaaaactcaaaacctcccccttcataaatgtggtatttgtccatgtttacatggaggttccactcagcccttgaggagcaaagcagcaagtggggcagtcactgtttcctcaggttgaggccttggactccttatcttccccactggctcttggtttatgagttccccttttaaggatctgttgtgacttacctatctgggctagtgacctcagatgtctcagactgagcatcttaccactgtttctggttgatcccttcactcatggtcttaacacatttgcacttcctctcatctcagagagtacagtcacggggcagagcttgcatagggatccaggtgttactagtcttactctggagctggtccaactcagttcatggcacagaactagataggtctccctgcgcatctgtttactgcttagggaagccagcttttctacccacacacgttttagtttgaagagtatctatttttggagggttctttgggagttgggcaggcttctttggatcccagatacatttagagctttttgcattaagtgtgaggaaaataacttctctttgatgatgttgatacaccatgtgggcaccctggggcacaggggtttagctggggagattccatgagaatgaacccaaactactcttctttgctagggtcctttacccacacagaggtgagcctttcaggttcttcattttgcttagtttcttcccttgtccttggcatttaagaggcatccatgtgttagccagccaaagccccctgaaggagctggctgctttaaaggatttacttgggaggatgtcaaatggctttgccttctgcagacttcatttattttaatctttttatggctcctttctcttgctttaaaacaggattataagcacacagcaggtactgacacctgaagtcttactaaattcctgtcctcaggccatcctttttctcctgaaacctggactccaattttcaatgacgtttttgtttttctctttcaagcctaactatgggacagctttacgagaaggacttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293031 - DNA, 960 bp, Homo sapiens
gttgctaggctccgacagccgggaagtcccgcctgccgtgtagtcgccgccgtcgctgccgctgccgctgccgccgtcgttgttgttgtgctcggtgcgctgagctccgcggctccgcgagccggttccgtccccttcccgccgccgccatgaagtggatgttcaaggaggaccactcgctggaacacagatgcgtggagtccgcgaagattcgagcgaaatatcccgacagggttccggtgattgtggaaaaggtctcaggctctcagattgttgacattgacaaacggaagtacttggttccatctgatatcactgtggctcagttcatgtggatcatcaggaaaaggatccagcttccttctgaaaaggcgatcttcctgtttgtggataagacagtcccacagtccagcctaactatgggacagctttacgagaaggacttctgagggccattgctgggctaggtgcaccgtaactgcttgtgtatcttgtaaatagccagccattttcagttattataccagaacctcttcacatagacctattagtgcatttgtaactggatttatttcttaatatattggaaggttttgtttccttagactagtaaattatcatacagagttttattttgagtttttctttttgtgcattgtcctcatgcctgtattctccaggaaacttgtccttctggaaatcatattgaatgatatttctatatcgaagtgaggtaggtgcggtattaaagtgaaagggaaggtgatgcatttattctgggttatgcttgaagtgttagatggctaagtattaaaattatccaaattaaatccttagcagtcagaacacttgcttcactagaatatgccaactgccaatcatgttggactgagctaatttgttcctctttctgaaactattaaggtaaataattaacaataaaaattctcttataaaggc

SEQ ID NO: 293032 - DNA, 1753 bp, Homo sapiens
  misc_feature (1057)..(1057): n is a, c, g, or t
cagagtatttgaaatatcccattagcttactgttagtagttgtcttaggaacttcttactaacggtgaatagtaaccgctatttgttgagcatttactaagcactgtgtgtgtgtgtgtgtgtgtgtgtgtgtgagagagagagagagagagagagagagagagagagagagaaagagagagagagtctgtgggttattcccatttgacagattggaatattaaggcaaaaagatactaagtattttgtccaatacctcatagccattgacagagatgggaataaaaattggcctatgtaacatcaccaaagcccacgcagtgcctgtgggaaaaatgaatttcagatttagcttaatgtcacacacacacagcccacaaggaaatgcctgacaattacgctccatgttctgaaactgacgtgtcatcatcaccacagaattgccactttatgcctcagtttacccaacttcaaagtagagaaacatttcatcatttaattttacttgctaggataatgtatgaattagttaatgcttataaagaagtgatttgatgaggggaaagctctatctaaatgctaagtattatttattattcatgtaagcatattactgtacccttcaatcaccttttttggatgtttcaaatgggcaattactgtctctttgtgtaaagctttaaaaatttttaatttaaattaaaagttaatctaatttaggaaaactctgccagctggaatggaacacagacttttttttcccccttttccaaacaaaacagcaattcagaatagactctcttttaatatagtaatgtggataggctttcctgggctagcggtattaggaatgagggctaattagtaatggctgttttgtaatgctggtaatctatgtgttaggattagtgctgataatatatctgattaggtggaattaactgatatttagaaggatggagattcttttgtttatgaaatctccattttggggttacgatgtgtagctggagtggctgagtccttgaaatcaagttaacatggctttcccataacncagtgcccatatatgagtagagccaggaagcaatgagggtcatttgagctcaagaagacctttacatcttaaggcctcagtaaggagccctacaaatagtgaaaatcagagttcaaaggtcagaaatgtcaagtatgctttaaaaggagaagacatatttacctgagctcttcagttaacatccagcagtccttgatgggaaaattctttctatgtagcactttctgtcacatgcctgttgactcaaaagtaactggttttcgttttaaaatagaaaatgaaaaatgtatcattgaaagaaatcactgttttaattcctctcccctacaaatttgcatgttcaaccttccttttaaagtaaccatttttaaatgttccctagcacttaaattttaaggaaatatgcttagaaatcacattattcagttgcacagtttcagttgcccagcagtatcattaaatcctctggagtgattccagtcccacaaaaattagggacccctttacattgtttccatattcaaatggaaatctttttgcaagttagtaattaaagtatttaacctctctctccctccatttattagaaaactcttttttctttattttttcaattacgaaaaaactgctaaagccaatcaagcatttattttgataaaccgcttgtaacagtctcagctaaattctgcaaatacc

SEQ ID NO: 293033 - DNA, 3620 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293034 - DNA, 4076 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaaaaaaaaaaaaaaaaaaaaaaaaaaaaaaaaaaaaaaaaaaaaaaaaaaaaaaaaaaaaaaaaaaaaagcaaaaaaacaaaaaaaagaaaaacaaaaaaacaaagaaaaaaaaaaaaaaaaaaacaaaaacaagacagcgaggcgaggcggcggcgccagcgccagaacatcctcgccccgagaggagagaagagagagaaaccgaagacccgccgcgcgccaacgagcgctagtagacagaagagagggagagcgacagagagagagaggagaggaaaagaatataaagaagcacgagaggggaggagggagcagaataaaaaagaaaaggaggcagggggagaaaacagaaggcgacaggagagcaagaagcagacagctcgtgcgaggagagaggaagcacaccaacatacagagggggaggggaagaggagaagaaagcaaaacgaagacagaggaggagaacacaaactccgagaacaaaaaaagaaacagagtcgaaccgcgcgagggcgggagagaaagaaaaaaaacaaagcgagtccggcgtacgaaggacaggaaagcgagggcgaaagaagaaaaacaaagagagcagagagcgcggactcagagagccgaggagcgagaagaaacgaaaaagaataagaggggagatgagagagaaagagagaagaagagaaacacgcagggaaaaacacaaaaacgccacgggggag

SEQ ID NO: 293035 - DNA, 3427 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaactgtgtacaattagggacgcagtttagtgatatctaggagtataaagttgtcgcccatcaataaaaatcacaaagttggtttaaaaaaaaaaa

SEQ ID NO: 293036 - DNA, 3673 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatgtttggcagagaaagcggaaatggaggtagtggcatgagtcagcagaaagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293037 - DNA, 3646 bp, Homo sapiens
tcgctattcatcggcacctcgctcgctattcatcggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagatttcagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293038 - DNA, 2552 bp, Homo sapiens
cagtgcgcaggcgcggcggccgatgcgagtgtgtatgtgcgggcgagaagatggcggcggcgggggaagcagcgtgagcacctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293039 - DNA, 2518 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293040 - DNA, 2579 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatgagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293041 - DNA, 2275 bp, Homo sapiens
aggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293042 - DNA, 2156 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293043 - DNA, 1898 bp, Homo sapiens
tgctgttcttgtcgtaaatagtagtgtaagcagatgctctccttttcagaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293044 - DNA, 1678 bp, Homo sapiens
ctcgagactagttctctctctctctctcttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293045 - DNA, 1712 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatgaacgattcgtttatgagaagactggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293046 - DNA, 1765 bp, Homo sapiens
acgcgtctgtggtttaccatgcagagcttaaatagaaatcctgccacgattgcatgcctatgcttacactgctgcatgctgtggaatatccccgatcaggacgaagagtaccgcatcaggtccatggaatgcacctggttacgagcgtaggctggctaagagatatcctgtccaagggtctcactcacttcaacaaacacagacccacaatcatgcagggtctgcaggcatcatgactcgtcaagcagtgcacgtcatgggtaaagacaacttccacctccttgtctctcgctgactgctgaccatgcacacacgtatctcgattatcatgagcacagcactgtggtgggtgccagaagcttatcaaaaatattgaatatcctgtggacttggaaattagtaaagaactgctttctccaggggttaaaaataagaattttaaatgccaccgaacctatcggctgtttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293047 - DNA, 1863 bp, Homo sapiens
cttgttttctcatttaatataccataagcgtattcccgcatcaccattcttaatctattccacgaaaaaataaattgtgttattttaatataatttactcatcagtcatttcttctagtggctattgaggttttccgttttttcactgttataaatgacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293048 - DNA, 1888 bp, Homo sapiens
tcgctattcatcggcacctcgctcgctattcatcggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagatttcagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagcctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293049 - DNA, 2404 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttgtccggggttgttaacaaccccggacaactaccccggacaagatctcccttataaatacacgtgatgccaaaaccatagtttctccagaagccagttttctgagtaaaggcaaaatggttgtcactggaaacttt

SEQ ID NO: 293050 - DNA, 2163 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagagttgggataagtcggagagtgactcaggtggtgtggggtaccgagctag

SEQ ID NO: 293051 - DNA, 1046 bp, Homo sapiens
cggacgcgtgggttttagaaaatacacaaaaacccatatttctaaaatcaagcaacagtctgtttcaaccaaatgattttgatttggaagttagagtcaacagaagctgtgttgtgcacgaaccccaaggcatctcctttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293052 - DNA, 1744 bp, Homo sapiens
cagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataacaatggcagattacctgtgtgttaatagcaacgtctgaaggatgcctatgtcttaaatgttctctaaaagtaagataatatagaaacaaatgggaggagagggttgtcgtaactttatgttaagtgaaagatccatgtctgttagcagttcttttctgttgacaagttacatttccatttcttgccttttgttcaagtaattctgctccacggtatgaatgtataatggactttttctgtgatatacctttggtatgataatcctgatttgtactcactgtgtgctccttttttatatttcttaagatacaagaaatcattttgtgaaataacatggttttttttttttgg

SEQ ID NO: 293053 - DNA, 494 bp, Homo sapiens
gaccgtaaaccagtctagtagactaacattttaactccaaagtattgatctgcaatgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaaaacacccccacaaaaaacactttgtggcgcgccttggcccccaaaaaaccttttacagacacttccgtgtcggacagccaggggcccagttaggaacagtactccgtggcccacagcgtggtcccccaaggacaccccggcgcaccgaccagtgtgcggcgttctccgcccaattaaaaacgccggggggaacacgacggtccgaacacaatccgagaggagccgaggccgacggactatcacagagatcacagaccaataaacg

SEQ ID NO: 293054 - DNA, 409 bp, Homo sapiens
actttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagccta

SEQ ID NO: 293055 - DNA, 790 bp, Homo sapiens
ctcgagagtttgcgccggttcgcattccccggcctcccgttcgctcccccgcgaaccaggcggccgtgcgcctctcggggcaaccacccaagagcacccgggcgggaggacgccgagcagggggtgttgcgggctgggacaggggcagccacctcccgaagatgcaggatggcagcagagccgcagccgtccagcctttcctaccgcaccacgggctccacctacctgcacccgctcagcgagctcctgggcatcccgctggaccaggtgaattttgtggtatgccagcttgttgctctgtttgctgctttctggtttcgcatctacttacgtcctggtacaaccagctctgatgtccggcatgcggttgccaccatttttggcatctattttgtcatcttttgtttcggctggtactctgtgcatctttttgtgctggtgttaatgtgctatgcaatcatggtcactgctagtgtatccaatattcacagatattccttttttgtagcaatgggatatcttacaatatgccacatcagccgaatatacatcttccactatggaattctcactacggatttttctgggcctctgatgattgtcactcagaagatcacaaccttggcattccaggttcatgatggattaggtcgaagagctgaagacctttctgctgaacaacatcgacttgctatcaaagtgaaaccctcttttttggaatacttaagttaccttctcaatttcatgagtgtcatagctggtccttgtaacaatttcaaggactacatag

SEQ ID NO: 293056 - DNA, 467 bp, Homo sapiens
ggaggggagggtagaggagttattgggtagattttaagtttagcaaatagaaaaaaaaaatctgaagatggatgatggtgatggttgcacaaagtgaatgtacttaataccactgaattgttacatttaaaaatggttaaaatgatttttaaaacacacacgtctgcccaagacagagcttgctctgaggccaaaactcttctaagggagctaggatctgaggaacaaaaataataattccaccctcagctcatcatgacaccattccctgtatagcccctgccacctctgcaatggaaaaatggccaacatgggctttgctgagttgctcagcagatccaaggcctcccaatggctttgctactccctgacaagagaagccttcctacaagaatgcctagtgacccacatataactagcattctcttctttctctcctcagctggagttatactcccaaagacaag

SEQ ID NO: 293057 - DNA, 12468 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293058 - DNA, 12445 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293059 - DNA, 3264 bp, Homo sapiens
  misc_feature (183)..(183): n is a, c, g, or t
attgcaacctccacctcccgggctcaagcaatccccccacctcagcctcctgagtcgatgggactacaggcacatgccagcacgcccagctaatttttgtatttttagtagagacagagtttcaccatgttgcccaggctggtcttgaactcctggccttaagcagtcctccctcccacctcngcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293060 - DNA, 1403 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggtatgtttattttaaggaagtcagctaacttgtagaagctttagagtttcaagttttttatgcaagtggtttttttttgttaggcacatgaatcacaaaatttcataattaagctctttgtgtaatttatttcaaaagcaaatgggaatctcagtaatgtagtttttaagataatagtcattactgagttccctaaaagtgatcagcctatgttaaactgaattagcaggaaaatacaaatttatagctat

SEQ ID NO: 293061 - DNA, 685 bp, Homo sapiens
tagtagcagtatatgagagttacgttgcttcacatctttgccaacagttagtatagtcagacttctgttgccaatctgatgggtgtgcagtggattcttattgtggttttaattggctgttctctagttcctgaagggtttagtcctttttcatatggtaattggctagttggatttttatttttgtgatatgcttgtttaggtactttttgataacagtatctggtcttttaaattgagctacagatggaaatcattagaaagtaaagtgaaatctaattttcatcatgtccactgaggacacatacctgtgtgttcagtaattttgtgtcatgtactggtagaaacatgtatcctttggaaaattttgaaagtcacagcatggtctcacattggtcattataaagctgaagcaggctgggccctgtggttcacgcctgtggtcccagcactttgggaggccgaggtgggaggatcacgaggtcaggagtgcgagaccagcctggccaacatggtgaaaccccgtctctgctaagaatacaaaaattagcttggcgtgatgctcggtgcctgtggtcccagctactcgggaggctgaggcaggagaatcgtctgaacttaggaggcagaggttgcggtgagttgggatcgtgccattgtactccagcttggacgacagggcaag

SEQ ID NO: 293062 - DNA, 869 bp, Homo sapiens
attccagatactcagaaatactcatattcaaaagtaaacaaaataacattttgaaagccgaatttttgtttgtactgttttctcctttagcaagaataatagaaaatgactataaataggagattgtataatatagtataatagtcttttgagcagttacctattttgtagaaattttttaaggtcttgggattttatttttctttacaaggaatattttgggttactttaggtgcagaaaagactgactcattttatcattcttctggtgggctggagttatatggagaaccaagacatactacgtatcgctcaagatcagatctggactatattaggtcccctttaccatttcagaataggtaagaatatgagaaaacctgcctggaattgttaaatgtattaatatttaacagagataaatggacatttttagggctttgacttctttgcattgagatagacatctttgttatatataatttacataatatgaccaagtgcggtggctcacacctataatcccagcactttgggaggctgaggcgggcagatcatgaggtcaggagttcaagaccagctagttggagactagcctggccaacatggtgaaaccctgtctctactaaaaatacaaaaaattagccaggcgtggtggcaggcgcctgtggtcccagctacttgggaggctgaggcaggagaatggtgtgaacccgggaggcggagctggcagtgagctgagattgtgccactgcactctggcctgggcaacggagcgagactctgtctcaaaaaaaaatacaaaaaaattagccaggcatggtggtgggtgcctgtaatcccagctactcaggaggctgaggcaggag

SEQ ID NO: 293063 - DNA, 12617 bp, Homo sapiens
gatctgtggagcccagaaagttgaggtgagctgtgatggcgctactgcactccagcctggatgacagagtaagaccctgtctcaaaaaataaaataaaatcttggtgagattatattctcactaagcagtgaatgacagtgcctgatttcccttattctgcctaattctgggcttattttcttttatttagacatgacattttcagttcttacccctcaatatttcagtaggtttattcagaaatgtttctttgcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293064 - DNA, 11416 bp, Homo sapiens
tcaagggtcccttaagccccatcccttagcccagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293065 - DNA, 7461 bp, Homo sapiens
  misc_feature (315)..(315): n is a, c, g, or t
  misc_feature (439)..(439): n is a, c, g, or t
  misc_feature (653)..(653): n is a, c, g, or t
tgaatagctcagttcagaagagcttttccttttgaatagagtgaagcagcaagagcaagagaaataatgttacaactgcatttctcaagactgctgctatggagatttcaaacttgaccttccctgccaggttctgctttgaaggcttacttattactacagacatcgctgatattaaaagcagttttattgctcgtctaattagatgtttatatttttattcttctcttcaaggacttaattatgctagtttaaaaggtgtttttgtttgcttgcttttatttttgttttttgattttttttggtttttgtttnggtttgggtttttttgagggggcatcaagattgatagagacctaagtttttttagatttgtagtttttttcctggactttccccttccttttattgtgcagttgtatgaattaattttataacntttatttgatagtgctaaaaaagaaactttttatactgctatggtagatcttgataaactaaaaagaactttttaatgtattagaaaattgataaagcaaattaggaatctcggcagctgtatcttctgggatggattcttatagcacctatttggcaactgtcaaagtcagtggctcgtggttagaagagcaagatgaagacatttatgaggntgaatctcgcgtgcctttaccacatccttttcctctttgtgaacatttggatgaaaataactcagtaattgttaatacttctattttccattttattcataaaagaaacgggcatatattaaagcttatttctaaaatttcactgcctacccctccttattcacttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293066 - DNA, 12298 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggtgctctgagtttaaccacatcttggcagcaccacagtgcgagacccacagctcccctttctttgaaattctttcacactcattaggataatcaaagcttccagtttagtgcatgagctaattattaagttagccaaagcttaaactcttgtaaccagcagagaaactgactttaaataatttaagtgaaaatatgatttatcaccccagatcccactcctcccaaaaatgatttcctactatgttcattcagcggactgatgacacaaaatgcacaatgagcaccagtgtgcaaggtactctgagtctacagagcctaactggagaacgtattcctaagtagcgcatggcagaaagtggtaaggccgtgccgcagcactccagcctgggcagcagagcgagaccctgtctca

SEQ ID NO: 293067 - DNA, 9076 bp, Homo sapiens
tatgaatgttactcttttgcttgatatgatttctttagaatttatagatttctttctgatcagcatttctgaacgtccatccttgtcctgtgatgttttttcaaaggtatttgagattacagagataacatcagaaataggatccaagctaggaagtggttgattaaagtataagataaattttattattataaggaagcagaaaaaattatagttttgtgcaatgaagtttattatcttcctgatataagaagatttcatgccagagagatagatttagacttgtttcttttgcagattgataagggtatggagagaatgttttcttaattatttttgtgtgccattttgaccgccttgcatctaggagaattatgtttaatctttagaagcagaaatctaaatttaaattccttaaaatacacaattttgttgttaacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293068 - DNA, 9144 bp, Homo sapiens
gcaaagttgataatctgtagtgaccaatgattgtactgaacgactagattagataactcggtagatcatgactgttcctcgtgtgaaattttgtttcctcccatattgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293069 - DNA, 12466 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgagggggagggggtgttttttcttttttttttgttttttttttttttcctaatacaaagaccccccc

SEQ ID NO: 293070 - DNA, 10682 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaaggtatgttgtatgacaagctcatatggttacacaaacaggtgaaaagatttcactttgttttctttcttattattattaagttaaaacatattttcttggtcacattttcttctcattctcataatgttaaggatacaatctatattaattactctaggggttagaggattgtctaattggtttaaacagctacgttgactttaaaataaactgccattcccctgataaggttaagcccattggattcattctttttctttattttagagctgtatgttaagaaaacagtctttccaatcataaaacagaaaatactctttagaggaaaatccacaatgcatgtaactaattattttttaatccttttttaaaaaaattgtgagccataacatacagaaaattacaaattgcaaatatgcagtatgacgcatttttaaatgagtatctatggaaacatcacccatgtgaatatagccagtatcccaacagccccttctcccaagcacatgctcctctgagtaacttagaggtaatcattgttctgatttttctttagttttactatctatttatatattcctaaaacatttaagtttcaagtttttttctgtttttgaactttatcaatctgtatgtattttttatcttgtttctttcacctctctgtaacattcttccaacattcttccaagttactgcatttttcaagttactgcattcttccaaattagtagtagaacattcttccaagttactgcatttatctctagttcattcattcttgttactctataactctatgaccctgtgtagggccaggcacggtggcttacacctgtaatcccagcactttgggaggctgacgtgggtggatcacgaggtcagaagttcaagatgagcctagccaaaatggtgaaacccagtctctactaaaaatacaaaaattagccaggcgtggtggcgggtgcctgtaaggccagccactcaggagactgaagcagagaattacttgaacccagaaggtggaggttgcagtgagctgaaatcacaccactgcactctagcctgagcgacagagcaagactccatctcaaaaaaaaaa

SEQ ID NO: 293071 - DNA, 12458 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgacttctcccccacctccatagtgctagtatttggcattagcttctgggccttgtgtatgccttccctgggcttcaacactcctcttctgccctcctttgagctctgttggggtggaggatcagaggtcttgctcgtttattttccggctcattttagtctcatggtcagctttataaagtgggggggttgtggattcatgtaattgctctggtagtgacctagctttgtcctatggtcctctccctgcattacattgggggtttcagcaagcgcttgattattaatcgatgtacctaatgtaag

SEQ ID NO: 293072 - DNA, 3349 bp, Homo sapiens
  misc_feature (268)..(268): n is a, c, g, or t
tagtagcagtatatgagagttacgttgcttcacatctttgccaacagttagtatagtcagacttctgttgccaatctgatgggtgtgcagtggattcttattgtggttttaattggctgttctctagttcctgaagggtttagtcctttttcatatggtaattggctagttggatttttatttttgtgatatgcttgtttaggtactttttgataacagtatgctggtcttgaactcctggccttaagcagtcctccctcccacctcngcctcccaaagtgctgggattacaggtgtgagccaccatgcctggactgcattaccaactcttgggactataatttttcatgtttcctttgaagtaatctccttaactacaaatcagttcttatcaacaaatatttataaaccaaatatgagttgcttgattatgtttcaaatattaatcatgttctgtgtagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293073 - DNA, 12275 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaaccagaattgtccctagaagtacaattgcaggctgaacgagatgccatagacagaaaggaaaaagagattacaaacttagaagagcaattagaacagtttagagaagaactggaaaataagaatgaagaagttcaacaattacatatgcaattagaaatacagaaaaaggaatctactacccgcctacaagaacttgaacaggaaaacaaattatttaaggatgacatggagaaactgggacttgccataaaggaatctgatgccatgtctactcaagaccaacatgtgctatttgggaaatttgctcaaataatacaggaaaaagaggtagaaattgaccaattaaatgaacaagttacgaaactccagcagcaacttaaaattacaacagataacaaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattgcagaaaaaaatgttttagaaaaagaaaagaagctgctagaactacagaagctattggagggcaatgagaaaaaacagagagagaaagaaaagaaaagaagccctcaagatgttgaagttctcaagacaactactgagctatttcatagcaatgaagaaagtggattttttaatgaactcgaggctcttagagctgaatcagtggctaccaaagcagaacttgccagttataaagaaaaggctgaaaaacttcaagaagagcttttggtaaaagaaacaaatatgacatctcttcagaaagacttaagccaagttagggatcacctcgcagaggcaaaagagaaattgtccattttagaaaaagaagatgagactgaggtacaagaaagcaaaaaggcctgcatgtttgagccacttcctataaaactgagtaagagcattgcatcccagacagatgggactctgaagatcagtagcagcaatcagactccacaaattcttgttaaaaatgcaggaatacaaattaatttacagagtgaatgttcctcagaagaagttactgaaataatcagtcagtttactgaaaaaattgagaagatgcaagaactacatgctgctgaaattttggacatggaatccagacatatttcagaaactgaaaccttaaagagggaacactatgttgccgttcagttactgaaagaggaatgtggtaccttgaaggcagtgatacagtgtctgagaagtaaagagggatcctcaattcctgagctagcacattctgatgcttaccagactagagaaatatgctccagtgattctggatcagactggggtcagggaatttatcttacacacagtcagggatttgacatagcatcagaaggccgaggagaagaaagtgaaagtgcaacagattcctttccaaagaaaataaagggattactgagagctgtccataatgaaggcatgcaggtgctttctctcactgagtctccctatagtgatggagaggaccattctattcagcaggtttcagaatcttggctagaagagagaaaagcttacatcaatacaatctcatctctaaaggatttaattacaaagatgcaactgcaaagagaagccgaggtttatgatagttctcaatctcatgagagcttctcagactggcgaggtgaactactgcttgcccttcaacaagttttcttagaagagcgtagtgttttactagcagcatttcggacggagctgacagctctaggtactacagatgcagttggtttactaaactgtttggaacagagaatacaagaacagggtgttgaatatcaagcagctatggaatgcctccagaaagcagatagaaggagtttgttatctgaaattcaggcactgcatgcacaaatgaatggtaggaaaattactctgaaaagagaacaagagagtgagaaaccaagccaagaactcttggaatataatatacagcagaagcagtctcaaatgctggagatgcaagtggagctcagcagtatgaaagacagagcaacggaactgcaggagcagctgagttctgagaaaatggtggttgctgaactgaagagtgagcttgcacaaactaaattggaactagaaacaacactcaaggcacagcataaacacctaaaagaattggaggctttcaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctggaagagaaaagacaacaagtttataagttagaccttgaaggacagcgactacaaggaatcatgcaggaattccagaagcaagaactagaacgagaagaaaaacgagaaagtagaagaattctgtatcagaaccttaatgagccaaccacgtggagcttaaccagtgatagaactagaaattgggttcttcaacagaaaatagaaggagaaacaaaagaatcaaactacgctaaattgattgaaatgaatggaggaggaaccggctgtaatcatgaattagaaatgatcagacaaaagcttcaatgtgtagcttcaaaactacaggttctaccccagaaagcctctgagagactacagtttgaaacagcagatgatgaagatttcatttgggttcaggaaaatattgatgaaattattttacaactacagaaattaactggccagcaaggtgaagagcccagcttggtgtccccaagtacttcttgtggctcattgactgaaagactactgagacaaaatgctgagctgacagggcatatcagtcaactgactgaagagaagaatgacttaaggaacatggttatgaagctggaagagcagatcaggtggtatcgacagacaggagctggtagagataattcttccaggttttcattgaatggtggtgccaacattgaagccatcattgcctctgaaaaagaagtatggaacagagaaaaattgactctccagaaatctttgaaaagggcagaggctgaagtatacaaactgaaagctgaactaagaaatgactctttacttcaaactctgagccctgattctgaacatgtcactttaaagagaatttatggtaaatacttgagggcagaaagttttcgaaaggctctcatttaccagaagaaatacctgctgctgttactgggtgggttccaggaatgtgaagatgccaccttggccctgcttgcccggatgggggggcagccagctttcacggatctagaggtgatcaccaatcgcccaaagggcttcaccaggtttcggtcggccgtcagagtatccattgcaatttccagaatgaaatttttggttcgacggtggcatcgagtcacaggttctgtttccatcaatattaacagagatggctttggactgaatcaaggtgcagaaaagactgactcattttatcattcttctggtgggctggagttatatggagaaccaagacatactacgtatcgctcaagatcagatctggactatattaggtcccctttaccatttcagaataggtaagaatatgagaaaacctgcctggaattgttaaatgtattaatatttaacagagataaatggacatttttagggctttgacttctttgcattgagatagacatctttgttatatataatttacataatatgaccaagtgcggtggctcacacctataatcccagcactttgggaggctgaggcgggcagatcatgaggtcaggagttcaagaccagctagttggagactagcctggccaacatggtgaaaccctgtctctactaaaaatacaaaaaattagccaggcgtggtggcaggcgcctgtggtcccagctacttgggaggctgaggcaggagaatggtgtgaacccgggaggcggagctggcagtgagctgagattgtgccactgcactctggcctgggcaacggagcgagactctgtctcaaaaaaaaatacaaaaaaattagccaggcatggtggtgggtgcctgtaatcccagctactcaggaggctgaggcaggag

SEQ ID NO: 293074 - DNA, 1082 bp, Homo sapiens
ggtatagcaaacaagctgaccattttttatttagtgtatgctatggttagatattgggaaaagtattgactaaaattgatactctgatcattatgaaaagcttaacagtcttcatgacaagatacatttatacatacccaatttattgagacctctgccacaagcattgtattggacattcttatgttgacttagtagcatctttgaattcattggagagttgtctctttctcatcccaagctccaaagctgaagcttggaggagatacattatgtgtgtacaagtgacccacctttttggggaagggagtggaggcaggttggtaacttatatgcatatttctggataacttgattcatgtacatatttttaatcctttaggtacccaggcactccagctgatttcaatcctggttctttagcatgttctcagcttcagaattacgatcctgacagagccctaacagattatatcactcggctagaggcactgcaaagacgacttggaactatacagtcaggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293075 - DNA, 6885 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagagatcctccatagataatgaaaacctggtttcagagagagagagggtgcttttagaggagctggaagcactaaagcagctgtctttagctggaagagagaagctgtgttgtgagctgcgcaacagcagtacgcaaacacagaatggaaatgaaaaccaaggagaagttgaagaacaaacatttaaagaaaaggaattagacagaaaacctgaagatgtgcctcctgagattttgtctaatgaaaggtatgcactccagaaagctaataatagacttttgaagatcctcttagaagttgtaaagacaacagcagctgttgaagaaacaattggtcgccatgtccttgggattctagatagatctagtaaaagccagtcatctgccagcctaatttggaggtcagaagcagaggcatctgtaaagtcatgtgtccatgaggaacatacaagagttacagatgaatccattccctcttattctggaagtgatatgccaagaaatgacattaacatgtggtcaaaagtaactgaggaaggaacagagctgtcacaacgacttgtgaggagtggttttgctggaactgaaatagaccctgaaaatgaagaacttatgctgaacattagctctcgactacaagcagcagttgaaaaactcctagaagccataagtgaaactagcagtcagcttgaacatgcgaaagtgacacagacagagttgatgcgtgagtcatttagacagaaacaagaagcaacagagtcccttaagtgccaagaggaacttcgagagcgccttcatgaggagtccagggccagagaacagctagctgtggagctcagtaaggctgagggcgtcattgatggctatgcagatgaaaaaactctttttgaaaggcaaattcaggaaaaaactgatataatagatcgtcttgagcaggagttgttatgtgcaagtaacaggttgcaagaattggaggcagagcaacagcagatccaagaagaaagagaattactgtccagacaaaaggaagctatgaaagcagaggcaggcccagttgaacaacaattactacaggagacagaaaaattaatgaaggaaaaactagaagtacaatgtcaagctgaaaaagtacgtgatgaccttcaaaaacaagtgaaagctctagaaatagatgtggaagaacaagtcagtaggtttatagagctggaacaagaaaaaaatactgaactaatggatttaagacagcaaaaccaagcattggaaaagcagttagaaaaaatgagaaaatttttagatgagcaagccattgacagagaacatgagagagatgtattccaacaggaaatacagaaactagaacagcaacttaaggttgttcctcgattccagcctatcagtgaacatcaaactagagaggttgaacagcagcaaatgattgaaaaaattgacatgacaggtcgagagggtagaaccaaagtccaagctcgaattgcccagcttagtgacattcatgcagtaaaggagctgaaccttcaagaatacagacagcacccttgtgctcaggataatggtggctgttcacatatttgtcttgtaaagggggatggtactacaaggtgttcttgccccatgcacctggttctacttcaagatgagctatcatgtggagaacctccaacatgttctcctcagcagttgacttgtttcacgggggaaattgactgtatcctgtgcttgacgtaagggaat

SEQ ID NO: 293076 - DNA, 5619 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggaacaagataaaaaagtagaaaactcaaataaagaagaaatacaggaaaaggagacaatcattgaagaattaaacacaaaaataatagaagaagaaaagaaaactcttgagctaaaggataaattaacaactgctgataaattactaggagaattacaagaacagattgtgcaaaagaaccaagaaataaaaaacatgaaattagagctgactaattctaagcaaaaagaaagacagtcttctgaagaaataaaacagttaatggggacagtcgaagaacttcagaagagaaatcataaagacagccagttcgaaactgatatagtacaacgaatggaacaagaaacacaaagaaagttagaacaactccgggcagagctggatgagatgtatgggcagcagatagtgcaaatgaaacaagaattaataagacaacacatggcacagatggaggaaattaaaacacggcataagggagaaatggagaatgctttaaggtcatattcaaatattacagttaatgaagatcagataaagttaatgaatgtggcaataaatgaactgaatataaaattgcaagatactaactctcaaaaggaaaaactcaaggaagaactaggactaattttagaagaaaagtgtgctctacagagacagcttgaagaccttgttgaagaattgagcttttcaagggaacagattcagagagctagacagacaatagctgaacaagaaagtaaacttaatgaagcacataagtcccttagtacagtggaagatttgaaagctgagattgtttctgcatctgaatccagaaaggaactagaattaaaacatgaagcagaagttacaaattacaagataaaacttgaaatgttagaaaaagaaaagaatgctgtgttagacagaatggctgaatcacaagaagctgaattagagaggctgagaacacagcttctatttagtcacgaagaagagctttccaaactgaaggaagatttagaaattgaacatcgaataaatattgaaaaacttaaagataatttaggcattcactataaacagcagatagatggtttacagaatgaaatgagtcaaaagatagaaaccatgcagtttgaaaaggacaatttgataactaagcagaatcaattaattttggaaatttcaaagctaaaagatttacagcagtctcttgtaaattcaaagtcagaagaaatgactcttcaaatcaatgaacttcaaaaagaaattgaaatactcagacaagaagaaaaagaaaagggtacacttgaacaagaagttcaagaattacaacttaaaacagaattgttagaaaaacagatgaaggaaaaagagaatgatcttcaagaaaaatttgcacaacttgaagcagagaatagcattcttaaagatgaaaagaaaacccttgaagacatgttgaaaatacatactcctgttagccaagaagaaagattgattttcttagactccattaagtccaaatccaaagactctgtgtgggaaaaagaaatagaaatacttatagaggaaaatgaggacctcaaacaacaatgtattcagctaaatgaagagattgaaaagcaaaggaacactttttcatttgctgaaaaaaactttgaagttaactatcaagagttacaagaggagtatgcttgccttctcaaagtaaaagatgatttagaagacagtaaaaataaacaggaattagagtataaaagtaaacttaaagcacttaatgaagagcttcatttgcaaagaataaatccaactacagtgaaaatgaaaagttctgtctttgatgaagacaaaacttttgtagcagaaacattggaaatgggtgaggttgttgaaaaggatacaacagaactcatggaaaaacttgaggtaaccaagcgagagaaattagagctgtcacagagactgtctgatctttctgaacaattgaaacagaaacatggtgagattagttttctaaatgaagaagttaaatctttaaagcaagagaaagaacaagtttcattgagatgtagagagctagaaatcattattaaccacaacagggcagaaaatgtacagtcatgtgatactcaagtaagctctttattagatggagttgtgactatgacaagcaggggtgctgaaggatcagtttctaaagtaaataaaagttttggtgaagaatcaaaaataatggtggaagataaagtttcttttgaaaatatgactgttggagaagaaagtaagcaagaacagttgattttggatcacttaccatctgtaacaaaggaatcatcacttagagcaactcaaccaagtgaaaatgataaacttcagaaagaactcaatgtacttaaatcagaacagaatgatttaaggctacagatggaagcccaacgcatttgcctctctctggtttattcaactcatgtggatcaggttcgtgaatatatggaaaatgaaaaagataaagctctttgcagtcttaaagaagagcttatttttgctcaagaggaaaagatcaaggaacttcagaaaatacaccagttagaactacagactatgaaaacacaagaaacaggtgatgaaggaaagcctttacatctgctcattggaaaacttcaaaaggcagtgtctgaagaatgttcttattttttacagactttatgcagtgtccttggtgaatattatactcctgctttaaaatgtgaagtaaatgcagaagacaaagagaattctggtgattacatttctgaaaatgaagatccagaattacaagattatagatatgaagttcaagactttcaagaaaatatgcacactcttctcaacaaagtaacagaagaatacaacaaactcttggtacttcaaacacgactaagcaagatctggggacagcagacagatggtatgaaacttgaatttggagaagaaaaccttccaaaagaggaaacagagtttttatcaatccattctcagatgaccaatttggaagacattgatgtcaatcataaaagcaagttatcttctctgcaagatcttgaaaaaactaaacttgaagaacaagttcaagaattagaaagcctcatatcctctttgcagcaacagttgaaagaaactgaacaaaactatgaggcagagatccactgtttacagaagaggcttcaagctgttagtgagtccacggttccgccaagcttacctgttgattcggtggtaattacagaatctgatgcacagagaacaatgtaccctggaagttgtgtgaaaaagaatattgatggtacaatagagttttctggtgaatttggagtgaaagaggaaacaaatatcgttaagttgcttgaaaaacaataccaagaacaattagaagaagaagtagctaaggttattgtgtcaatgagtatagcatttgctcaacaaactgaactgtctagaatatctgggggaaaagaaaatactgcatcatcaaagcaagcacatgctgtgtgtcagcaagaacaacattattttaatgaaatgaaattatcacaggatcaaattggttttcagacttttgagacagtggatgtgaaatttaaagaagaatttaaaccacttagtaaagagttaggagaacatggaaaggaaattttattatcaaatagtgatccccatgatataccagaatcaaaggactgtgtgctgactatttcagaagaaatgttctccaaagataaaacatttatagttagacagtctattcatgatgagatttcagtgtcaagcatggatgcttctagacaactaatgttgaatgaagaacagttggaagatatgagacaggaacttgtacgacaataccaagaacatcaacaggcaacggaattgttaaggcaagcacatatgcggcaaatggagagacagcgagaagaccaggaacagctacaagaagagattaagagacttaatagacaattagcccagaatggaaatgaaaaccaaggagaagttgaagaacaaacatttaaagaaaaggaattagacagaaaacctgaagatgtgcctcctgagattttgtctaatgaaaggtatacaaaatgtgtactttttcagtgcaaagtaaattaaaatggttgtttcaatgtaatagactttgtccttatttttatcttgtacattgatactttgtcttaaaaatcatcataccatctgtgtatgaaacatgtccatgtatgtgtagtatgtaaaggattttcagtttttcatcattaaatagataacattttaaaaaaatcttttctatataaattttgattggatattaatcacatacttaactgttaatcacctgatgttagcaaaacttttccttactttgattttgtagaggttaatataaaaatgtgaaatattaagtgagaatagttatcctacattagtattaaagactttaagcacaatatt

SEQ ID NO: 293077 - DNA, 1184 bp, Homo sapiens
aaaagatttttcaaaaatgtatgaggtatagaacatccaactttgagagcactttaaaaaaactctaaatattagtctcacctaccttgccatagagccagtcatggtgatttttacatatatattcaaaatctcttaaaagtcagcttaagtatatgggctgggcgcggtggctcatgcctgtaatcccagcactttgggcggccgaggcaggcggatcactaggtcaggagttcaagaccaaccagttcgagactagcctggccaacatggtgaaaccccgtctccactaaaaatacaaaaatttgctggacatggtggcatgtgtggatagtcccagctactcaggaggctgaggcaggagaatcacttgaacccaggaggcgggggttgcagtgagccaagatcacaccactgaattccagcctgggcaacagagtaacactccaccttgggggtagtggggagagactcagtttaagtatgaagaggacattttaaggaaaaaaagggctttaaaaaaatggagaataataataatttcctttgtgtgaactctggtgggtctgatacaggtagcaatgtaatttgaaatcagttgaatttcctgtttttctctcataggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtattttgtcaagtactgaaataaaaatgacttcaccattttcaccaaaatatattt

SEQ ID NO: 293078 - DNA, 1204 bp, Homo sapiens
gaagatggcggcggcggcggcggtgacggcgcttcccgtgcggctgaggacgatccgccagtgagcgcggagactgcttccacttcgggcgggggagcgccggaccgaatcggctctctaggccgtggagcttgccgtcccacctccgtccaaatcgacctttcctttctatccccaaccacccctcaacccctgttttcccctgccttccttgcagaggccatggaggacgaggagagacagaagaagctggaggccggcaaagccaagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaactggaaagtgaaatttcaaccacagcagatgactgcagttcagaggtaaatggttgcagttttgtgatgagaacaggaaagcctacaaatttattaagggaagaagaatttggtgttgatgattcttattctgaacaaggagcacaagacagtccgactcatctagagatgatggaaagtgagttggctgggaagcagcatgagattgaagagctaaacagagagctggaagaaatgagggttacctatgggactgaaggactgcagcagttacaagaatttgaagctgccattaaacaaagagatggcattataacccagctcactgctaatttacaacaagcaagaagagaaaaggatgagacaatgagagaatttttagagttgacagaacagagtcaaaaattacagattcaatttcagcaattacaggctagtgaaactctgagaaacagcactcatagtagcacagctgcagacttactacaagccaaacaacagatcctcactcatcaacagcagcttgaagaacaagaccacttattagaagattatcagaaaaagaaagaagacttcacaatgcaaattagtttcttgcaagagaaaattaaagtatatgaaatggactaattgactagagaaacatgaagacgagttatatgccagtaacagggag

SEQ ID NO: 293079 - DNA, 655 bp, Homo sapiens
gcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaagtaagtattctcccagatttttaatcattatggttctcgatggaaagtagtcataacaacagtcattagcaactgtgcgcaatttgatcatgatttttatgtcctcttgaaagttttagtagtatggtaactaaacagtcataactaaaatatttgatcatctcagagagggagttttgtgagtttaatttaatatatgttgaacaactgcagtacaccaaagactgagca

SEQ ID NO: 293080 - DNA, 575 bp, Homo sapiens
gaaagactactgagacaaaatgctgagctgacagggcatatcagtcaactgactgaagagaagaatgacttaaggaacatggttatgaagctggaagagcagatcaggtggtatcgacagacaggagctggtagagataatgtatgtccatttttagcatctccatatatgagaattagtgcatgcttatcatttctgctgtctagttcaagttttaatcctgttaatgtaaaactatcacacacctgattcttaggatctgtagaaaattttatagggatgacaataataatattattactaagttataataattactgttatttattggaaaccatctctgtactcgactctgggttgtatacatacagaatctctaatccacatccaccttatacctgagaaaactgaattgaagtcgtagtcaaaccaagatacttgtatctccaaagccagatactttgctacctagggaccaacaacagatacacgagatgttcaaatgtgaatcctgactgttctcttcatttaattattagttattgtgttgatgactcaattaaaaggttctgtta

SEQ ID NO: 293081 - DNA, 2908 bp, Homo sapiens
ctctatggtgtaggagaaacccggcccccagaagattgtgggtgtagtggccacagccttacaggcaggcaggggtggttggtgtcaacaggggggccaacagggtaccagagccaagaccctcggcctcctcccccgccgccttcctgcagatctgcttggctttgaggaagagtggcagtactgcctcactgcataagggatgggatcagagaacagtgctttaaagagctatacactgagagaaccaccatttaccttaccctctggacttgctgtttatcccgctgtactgcaagatggcaaatttgcttcagtttttgtgtataagagagaaaatgaagacaaggttaataaagctgccaagcatttgaagacacttcgtcacccttgcttgctaagatttttatcttgtactgtggaagcggatggcattcatcttgtcactgagcgagtacagcccctggaagtggctttggaaacattgtcttctgcagaggtctgtgctgggatctatgacatattgctggctcttatcttccttcatgacagaggacacctaacacacaataatgtctgtttatcatctgtgtttgtgagtgaagatggacactggaagctaggaggaatggaaactgtttgtaaagtttctcaggccacaccagagtttctgaggagtattcagtcaataagagacccagcatctatccctcctgaagagatgtctccagaattcacaactctcccagagtgtcatggacatgcccgggatgccttttcatttggaacattggtggaaagtttgctcacaatcttaaatgaacaggtttcagcggatgttctctccagctttcaacagaccttgcactcaactttgctgaatcccattccaaaatgtcggccagcgctctgcaccttactatctcatgacttcttcagaaatgattttctggaagttgtgaatttcttgaaaagtttaacattgaagagtgaagaggagaaaacggaattctttaaatttctgctggacagagtcagctgcttgtcagaggaattgatagcttcaaggttggtgcctcttctgcttaatcagttggtgtttgcagagccagtggctgttaagagttttcttccttatctgcttggccccaaaaaagatcatgcgcagggagaaactccttgcttgctctcaccagccctgttccagtcacgggtgatccccgtgcttctccagttgtttgaagttcatgaagagcatgtgcggatggtgctgctgtctcacatcgaggcctacgtggagcacttcactcaggagcagctgaagaaagtcatcttgccacaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccgaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 293082 - DNA, 1640 bp, Homo sapiens
gaatgcactagttattacttacatgcttccactgagttaataatgtaagtattatgtaattatttggataacatgtgacatcgttgatcttgagtaatgttctgctgggatctcttttgtttagtatgcatggatatttccaagtaattagacctatactactacacttccttaatgctatccttcccataagtgtagttcttacctttaaccagtattttatgagaataattattttccctacaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccgaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgatgcagttttcctcaaaatttgctgcagcagaaattactgagggagaggctgaaggctgggaagaagaaggggagctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaa

SEQ ID NO: 293083 - DNA, 710 bp, Homo sapiens
agatcatgatgggctcagtttgggacaggtggtcctacccttgaaaagagctgaaaagagaagcatggacaggaacataactgttagtaccctagatgagttctgagtgcgctctgcagaacactgccagtacatgaactttttattacagttctgtgatgtgagtacagatatgaagacttaacatttaaaaccttttgtcgcaatttgacagagtaattttatgtacccaacatatgtctttttaattttgttttgattgtattttttaaaaatggtaagtctgtgatggattgggaggggaagatactggtcttttaccacaggtagtttgagagccactgacctggaacacatatctaagataatgtagtttatctaagcacaatctgtttgcagcccaattgctcatttacaggggaagaaagagataggtattgtggttgtcaacccttattacctcatttgctcctaggttttgctgggcctgcgtgatactagcgattccattgtggcaattactctgcatagcctagcagtgctggtctctctgcttggaccagaggtggttgtgggaggagaacgaaccaagatcttcaaacgcactgccccaagttttactaaaaatactgacctttctctagaaggtaagaattattaaaaggtctaactttttgtgtgtcatttttttagatttttagtattatata

SEQ ID NO: 293084 - DNA, 3012 bp, Homo sapiens
  misc_feature (134)..(134): n is a, c, g, or t
  misc_feature (845)..(845): n is a, c, g, or t
agattaacggccgtcccgaatatgcagcagaggcacaggtctcccctactcatttcaaaatatattagccttgctctaattagatattaaattttaattccgttaaacttttttcttaagtgcacaaagcatcntactccctggaggcaaacacatcgggctgcttcagcgttagcgggatgcttagcattttgaatattgtggcaaaaaaattaaaagttcacttattaatatttatcagcagtatcataatttccatcctcttatttcagaatttcacttgaggcaaaaataccacaagtgtaattactctagcacagctattaatgtgctggatgataggccactgcgtcacatgaccttctattgttcatgggtttaaagagaaagcagggctttgtatttctttttcttcttttaaagtcgactgtagcatcttggcttttgtctggggtggggaggatctggggtctggttcactttgtaaaagtaaaccatgtctgtttaaacaatagaggtgtttaagaagactctttagttttcctgcagattgttcaagattacatgataatcacacggagtatttatttcctactgacaaaccaagtacttgttacatcaccaatggtaccaggagatgaagacgcgggttttgagcaggagcgagattaccacccaaaaaggagctacctgaggcagcccagcttctagcaaactttttacatgttgcacatttcagttcttaaatgaaggctactccagtgtcatttcattaaagtacctgggtgtagtactcaagtcccccctcaagagttcataagtaagcagtatccttttggccagtngtcctgtttttgcccctacccagactgttcgagaagcatattctatagataaatctgacatttgtcatccaataccattgcagtcctctgcagcatacattctcaatgggggctgtatcacccctagattggttctgagatactgcaatgtcttgtgtccttccaaaggaccataatacttgagcaaatatgaacatttcttggggtgagggcagaaagagagaaacaaaagtctaaaaagggacaataatgaaaaaacagttgagacctttagtatgatgggaacaggatgaggaaggaggagatactgacaggagccctgggtcttgctctgcattaaacagatatttatggacattaaacagatatttatggagcacgactctgtaccctacaggcccagaatagtcttaaggctcctgggaattgatgataggccatttacccagtttcagtttagaggcagattcactggccttagcatttcagtaattatatttatttatttttagcctgaaccagatttaataggagaaactactttctgcgtttcttttaattacttgtagtttacacagtaactttagaagagtaaatgaaagcatgcttcgatgctgccactgtaaataccattcattagtaacttattttccctggagtcttgtgaagtgtgaatttaaagcctgctctatctggaatatggaatagtattaagattacaagcacattttatattcatgagccggaaaggcaaaaaaaaaaaaaaagtgatcctccatcctctgaattctcttaactatgtgactaatttcaattagtatgctttgtcattacagaactgttcaggtttcatctctgaacatttgcttttggcatcttcttcagtagcccaaaactgtcctgccgttttccaagaacactttccgtccataatgaggcaaggggaataaattgatacaaattcatgatttgagaagtggattgtttccctctcttctacgagtttggatccctgatcagtagacagacacataagacaactttctactgtgcaaattaaataaggattctgccagcaggccttcctttccattaccgcctatttccatttttcaagacaagtaaaaataatagtggaacaatatcttcaaaaaaattactagagcaacataatgcatgatatacaatatataaaataggacagcagaatccactacagaaataaaacatgggacttgggacagattgcattatgctctgaaaagtgaagtaactaagggtaaccgtaaagcttcgtatttatagactgcctttcccctgaggatctcagagtggttaatgttccaggagcgagggtgcttatggacttctgcaccattacttaagcaacttcattttttggcagaggtgccagcttgatatgaaaccacatgctgtgcaaggaccatttatataattaactccatttttgtaacacacctgcttctaagtggacatcaactaccaaaaaaaaaaaaaaaaacactttgttaggcagaagcagttagtgaaaatttatctaaccttgggtgggttgctctgatcacttgcttaacagagagcgtgttcaagaagctctcttgcggatcaggcactgggatctctctgcagcccatttgatcattttttcaagggacaaggctggttttcatcacttacatcgttcttgcctgagaacccagggatcagtataagtgcttgcctttgtatgcgtttcactactgtggctgttgggtctcagcccatgttctatgatccaatcccaatcagcaatggccttgacctagaatactttgagagccaaagagaataaatactcatcccaagaaagttgccttctctagaggatgacaaactcatcccaatgaacacgttcatatcagcatttcaattttgtcttcacagtttttgaccagggaagctgctaaaataattaagctagcagcagccccacttttgccacattctgaccttggaatagtgaaattgtcttatgagagcttatcttatggtatttccagtggaaagacactcagcagaatttctgtgactgagacaacagtggtcacacctctctcagataaaagcagttaagatgcttgtccaactgcagtttgcaaaaaaaaaa

SEQ ID NO: 293085 - DNA, 1070 bp, Homo sapiens
  misc_feature (6)..(6): n is a, c, g, or t
gcggcncgcctcagtttccctggccgtaaaacgcgggcgatggcgctcgatgccccgggagacgccggggtccgcgggcccttccggcaccgggtcctccttcaggttcgggcacccggctgcctccacgcggggcgagcgcggcgatgggatcggtccgtgctgcgctcagccccgctttcgctatccctctgctccaggggcagcaaaatcagcagatgagcccccagcgcgcctgcggcccacacactgcggccgtaacagttaaacagacggggaacattcatgtgcgtagagctcttcacggggcgatacagaaatgtgtcgttctaaagcgttaacgacctgcaatttgcatatcctccaacacatggattttactgattcaattatggatgtgtgcaaagaatctgctgctcgggcgtggtgtcctcagtgctgagagagccccgcgacggcggtgcagctcctccagggcgcgcagccccgccacctggcgccaccgcgagggagcgcaggcccagggcccgggcagacgctggaggggacgcggcaggtgaagatggggcacctccacttcccttctaaaggagcctgggaataggctaggaaatgtccccactgtagaagacagcaggaacatctgacacgcggataacctgtgctgagctcgttatattcccagcatttaattctagccattaggcatgcgttagccacaacttcgcataggaaggttattgcagctatatgggaacactttcagtttcccaagttaaaacatgaaattgcacatcatcatttggatccccaaagaggaaaagaaaaattcacaacctgccagtgaaatactcaggccacttggatgaagaccgaggtcctccatagaatccaggtgttatttactaactaatcagaaattaatatcaaaataggacttaaaaataacaaggctgtgttattacagcagtctttccagttgtgtacgctttactaatctaaattgggtaacagaactggagaaaaggaagactacacagacttatcataagctgttagtgaacgtgata

SEQ ID NO: 293086 - DNA, 516 bp, Homo sapiens
cgcctcagtttccctggccgtaaaacgcgggcgatggcgctcgatgccccgggagacgccggggtccgcgggcccttccggcaccgggtcctccttcaggttcgggcacccggctgcctccacgcggggcgagcgcggcgatgggatcggtccgtgctgcgctcagccccgctttcgctatccctctgctccaggggcagcaaaatcagcagatgagcccccagcgcgcctgcggcccacacactgcggccgtaacagttaaacagacggggaacattcatgtgcgtagagctcttcacggggcgatacagaaatgtgtcgttctaaagcgttaacgacctgcaatttgcatatcctccaacacatggattttactgattcaattatggatgtgtgcaaagaatctgctgctcggtgagtcattgttaattgtcggctttggggggaatacataaaacgtggaatattggcaatttatcgtgtttcgaccttttataaaggcgtcaccaggctgct

SEQ ID NO: 293087 - DNA, 1526 bp, Homo sapiens
accgtcatcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctggatccacaccacccatgactgtgttcaaggggaacaaacggccttaccagaaagactgtgtgcttattattaatcatgacactggtgaatatgtgctggaaaaactcagtagcagcattcaggtgaagaaaacaagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgt

SEQ ID NO: 293088 - DNA, 756 bp, Homo sapiens
ctttttattttcggcccactttcaatatacgctaaaatcagtgtgcgtatcgtccggcggcgtgaagcttaatgaagacacgccgataacggtagcctatttaacagtttctgcgtatattagtcgacctaatggtcgacaagcaatttcacgggttatacctcggatgcttgggatggccggtttaacatcatttaagtataattaaaccgcttgccctagtcgtaacaccagagaacagttagtcagtaaacgaggattcatgcattaaccctctccaaagggtagctttagtcagtggctgcatctttgtttatttcatttttttttttaatgtaagatcacaatgaatctttgtcttttatattattgcaatttaaacttcctacttttaaaaatgtttagatttctaaagtggcaacttaaggaaaaaagtaattttggggagtggggtggggtggacttcatgctaggcaggtgcttgattaaaaataattcttgtaatcctagcattttgggaggtggaagtgggtggatagcttgagttcaggagttaaagaccagcctgggcaacatggtgaaaccccgtctgtaccaaaaatacaaaaaattagctgggggtgatggcacatgtctgtggttgcagctgcttgggaagcggagctgggaggatcgcttgagcctgggaggtagaggttgcagtaaaccaagatcacgccactgcactccagcctgggcgacagagtgagactcccc

SEQ ID NO: 293089 - DNA, 1400 bp, Homo sapiens
accgtcatcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctggatccacaccacccatgactgtgttcaaggggaacaaacggccttaccagaaagactgtgtgcttattattaatcatgacactggtgaatatgtgctggaaaaactcagtagcagcattcaggtgaagaaaacaagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcaatgtgacttctgccatgattgtgaggcttccccagccacgtggaactaaaccccagtgtgatggtggaagcagcatgaaaacaacatctccccaggcctcgcagtagaggcgaagggaacagggctgcccatgtgcctgtctctaaagacgccaccctcaggttgatgtcacctgtgggagaccgggtccacctacagacaccaggtgat

SEQ ID NO: 293090 - DNA, 1389 bp, Homo sapiens
accgtcatcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgt

SEQ ID NO: 293091 - DNA, 1019 bp, Homo sapiens
ctatacatttgagctcatcgagggcagtaaatattctattcatgtctgtatccctgatacataatatagtactggattacagtagacactcaaatgttgaatgaatagctcacatgacaaaattacaagtatcagtattttgaagtggtctggaaagaacatggggttctacagagacttctgagttttcagtcacctggacaaatttgagaaccactatttttgccctgctaatttaatgtctgtatctcctttcagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgt

SEQ ID NO: 293092 - DNA, 430 bp, Homo sapiens
tgtgtgcaacagaaggcaatctgaacataagaacaaattaagacagcctagaaattgcacagatgaagaatctacaaacaaggacattaaagaatattaaagcagcacagagaagttatttccaagaattcaagaagcttcaaaaaacaaaagttacaccaacacttgtgaagctggcctaatacacagcatgtgcacaaaccaagacttatgtggctgatggcaccttttcatccagagctttgtggtgttcaaataaggacttcagtgctttcagcacttccacttcgctggacacgcctgctggagactgcgcttgtctcttcaccacggtcatcctaagagaccgctcatgcctggagacaaggcattccaaatgctctaacagcagctgaaataaaaggccaaaataaagacttgttaaacagca

SEQ ID NO: 293093 - DNA, 447 bp, Homo sapiens
ctcccccaccaacctcagtggttcagtggtgtctgcaaaatgcatccatcctgccatctgagtagcagaactgtaagagaaagcaacattcacctttgtgtcacagatcaaatggtaacccactgaagaccaccccattaccttgtgctagaacggaactgcctctgccatctctctttaacagaagcacatcctgagaacctgagagctcaaggtaagtggctgaacactgtcaacacatacagacatctaactgtctccttactgtacagccatagcaagaaacaaacgcatgcaatgctgtcaaggtagaagacaccactgtttactaccccagtcccaaatatctgtgtacgttagcacagcctacctagctcttctgtcattgtctttttaagtaaacattatacatttgaactgaatttgtagcaatgacatactgctttt

SEQ ID NO: 293094 - DNA, 579 bp, Homo sapiens
cagctagcttgctgcagcgcgagctgtttttcagctgaaaggcgccccctgggtcctaagcctcctaggtcatgcaaaatctaactgagccaagaaaggaactcagccaagagatatgcaggttgtgcttagcagccgatcagtttgagacctgcgaggccgcatccccagggtttttcatctcttctgtttccatttgtaactgtaagagaaagcaacattcacctttgtgtcacagatcaaatggtaacccactgaagaccaccccattaccttgtgctagaacggaactgcctctgccatctctctttaacagaagcacatcctgagaacctgagagctcaaggtaagtggctgaacactgtcaacacatacagacatctaactgtctccttactgtacagccatagcaagaaacaaacgcatgcaatgctgtcaaggtagaagacaccactgtttactaccccagtcccaaatatctgtgtacgttagcacagcctacctagctcttctgtcattgtctttttaagtaaacattatacatttgaactgaatttgtagcaatgacatactgctttt

SEQ ID NO: 293095 - DNA, 354 bp, Homo sapiens
cagctagcttgctgcagcgcgagctgtttttcagctgaaaggcgccccctgggtcctaagcctcctaggtcatgcaaaatctaactgagccaagaaaggaactcagccaagagatatgcaggttgtgcttagcagccgatcagtttgagacctgcgaggccgcatccccagggtttttcatctcttctgtttccatttgtgtgagtacagaaaaaataattctatcaaggggcatcatgggatgtgggaaattataagcactaaaacacagaacaacttagggagctatgcacccaggaggaattcatgaccacataggggggaaaaaataagagtttctggtggggagtggag

SEQ ID NO: 293096 - DNA, 904 bp, Homo sapiens
ctcgtgcatgccaccacgcccggctaatttttgtatttttagtagagacagggtttcaccatattggccaggatggtctcgatctcttgacctcgtgatccacctgcctcggcctcccaaattgctgggattacagcactgtgccctcctaggaaattattttttaagtgaaattttatttttattttttttaggattttggtagagaatgagtaggcctactcatcaatatcaaacaggacatttagtttctttccttagaacagacataaatttaatttcatggtaatatgataataagaaaatgcttctatttttctttagcacctccatggttctcatatacccatgtctgtaaaaagtgacatgagaattttgttgggttacattttattgtatttattagattcgcttatatagatgacttaggcagaaataaagtcatgtctttagaaggtgaacaagccaacttgtgatggcctgccttttgcttttggcagttgggatgagaacaattgactctcccattggttgttagatagttgaaatggtgcgttggtggtcatacttagtgttctaggctgtgaaatcatggagttcttccacttccaagaatgactcatttgctgttggattctagtacagaatttagcagcctgatgtgtccccaaactgatttaatttctactgaagtgcccttgtgtacatttgttttgtaatttaccaaagtactacctgagtgtataatgactcctgcagtgagttaatgtaattgctgctttgaccattgttttaaatctgtgtactagagtaactgtgagcagaatgaaatcacattatctcagtgttcaaaatatcattctaataaagtacatgcattaaacaattttaaaaatccaactgt

SEQ ID NO: 293097 - DNA, 966 bp, Homo sapiens
tgttgctgcctccccccgacccccacaccatcccccgccacaacactatataggaatcctgctctgtcacccaggctagagtgcagtggtacaatctcggctcatggcaacctctgcttcccaggttcaagcaattctcctggctcagctctccgagtaactgggactacaagcttatgaaaatcaacaccaaaaatcaattatttcactggtaccttggaaagctaagtagtgttggaacatgacaagttagatgaaagacctttggacatttttcgcagcacaagagatctcctccgttttggcagacagcacaccagtcttcatttgggtcatcatctttattgttgccatctcctccaatccttgccgacctgtgcatgaggcttcgaattggggactttccattaacaaggctgctgagccctgactgtttgcagctttcattcatatctgcaggttcagttttcacatggttttccaggcttgccaatgcatccaattcactttctagatgcaggttggttgagagaggtggtgtcaagctactctcaggactgctcaactaaaacaaaacgatgacaaattcttgaagaatcatttaatctttattgtatgccatatgtgtatttaacagttatgtgaatatgcatatagatatactgacgtaacaaatttattttatagatcacaatagtgccataaagaaatgacaataaccccaaaattattcaggcacgctaacatatgattttaaggggtctgctcctctgataatgtctcactcaataataagtaaattaattaaactgttaagctattgattgggaagtgagcatagggttatacttttccttgagagagctaattatggcacaccccttttcacacccagaatcttttgcatagcattttagaagcattctataatattcttctgctcacctatcattctactatattgta

SEQ ID NO: 293098 - DNA, 398 bp, Homo sapiens
caatttatagcaagaaaaaagctgggtttaccccaagaatactgacttactttcaccaaaaagaaattgggggacaagagaggaaggagaagactgaaaaaaacaagtatgactctactattttatggtctctgaaatcaagagacaagaggttgcatgaacataaaataataaatggaagggaagaactacagctctgctaaaccaaaacctaccacttgtagatgcaaaaactgatccctgataattagtgaattgctcaagcttactacagaattagaaccagactgcaggttttgtaaccttagccccctattaatttagagttttatctattttccttatactgaatataaactaaaggccaggagatgaaatctactctttaacattaatgt

SEQ ID NO: 293099 - DNA, 334 bp, Homo sapiens
tggggttttgccatgttggccaggctggtctcaaactcctgacctcaagtgctccgcctgcctcagcctcccaaagtgctgggattacaggtgtgagctaccacacctggctaatttacgccaacattttacaaccctttcaaagcatttgctattgaaagaaggcattcagtggcaaaattctgacattccagtaaatattactacccaaagaaaagaaaattcttaatttcaagatcaaagtgccaatgcttttcttttctaaataagagtaaagaaaaagaaggcccttattacatctctagcaaataactctatctccaaagacttaggt

SEQ ID NO: 293100 - DNA, 709 bp, Homo sapiens
atttgtttttcttttttagagacggagtcctgctctgtcacccaggctagagtgcagtggtacaatctcggctcatggcaacctctgcttcccaggttcaagcaattctcctggctcagctctccgagtaactgggactacaaggtgtgtgccaccatgcctggctaagttctttttttttttgtatttttagtagagatggggttttgccatgttggccaggctggtctcaaactcctgacctcaagtgctccgcctgcctcagcctcccaaagtgctgggattacaggtgtgagctaccacacctggctaatttacgccaacattttacaaccctttcaaagcatttgctattgaaagaaggcattcagtggcaaaattctgacattccagtaaatattactacccaaagaaaagaaaattcttaatttcaagatcaaagtgccaatgcttttcttttctaaataagagtaaagaaaaagaaggcccttattacatctctagcaaataactctatctccaaagacttaggtaagaaattacaattcttcagaaaaatattctggcactgtttaaatatctactagttttctaatccaaaaggttaacactttcaaagagggcactattattcaattaaagttactgcttctcaggaatttgagaagatatatcttttttttttttttttttcaatttatagcaagaa

SEQ ID NO: 293101 - DNA, 1459 bp, Homo sapiens
attccgaaagaaacgtgtcaggcaagaagcgctagttcacgcctgtcattccaccgctttgggaggccaaggcagggggatcacttgccccagaagtttgagaccagcctgggcaacatagtgaggcccctgtctctacaaaaaacttaaaatcaataaacaggtctccttccttcctcaatagtcctgttggtggctcacctctctgcctctccagatgtgaggcagatccacacgtttagctattgagataaggctgggcgtggtggctcacacctgtcattccggcctcagatctcttgtgcccaggagttttaagactagcctgggcgacctggctggcaacatggcctccacaaaaataaataaaacattttaaatatataaacattgagataatagcatcttgatgcctgtcttcattttttgtcttctgttttaaggactattagagacaaactaaccaaagataattctcccctcccacgtggctcgtgctgggacgccggcaccgtgagatggcgcccgtggccagatagagggtggcgtgtaaagcaggtggtcacccgtcactcgacttttcgcgtgctggtgagggtggtcgcatgtccatggatcagggctcacacctggcccatctggtggctgtgccatgggaggagcagagccacagccccgctccttgctgtgggtttcccgtgtcctccctgccctgcagtcccctgactccagctctggattagacaccccctgcttcccactgtgcacccgcccagagaagcacagcatgcgtgcctgcacttgcccccacgctgctaccctgctctgggtaccaaggacacaggcacagcagagcccccaccctcgaggcacctgtcatcttgtgacagggacaggctgaggggcaaatgaccagaaagggtggcaagtgccatgtcagacatatggtcttcatacaggggatgtcccaggactgctgggccagagacccctccatgtgggtcagcatcacccaagccaaaggccaaggaggtctcttggggggtgtggccgtcagaacaaagctgccaatgcgcgtacttttaaaggtgcggtcagctagtgaggctgtggctggccctggctgcatccagaccctggagtgtcctgcagccaggggcggatgcaggttttgtggggcctgaggcttctgtggtttaagggaccttccttaagaaaatacaaaattaggaacaggccttgaagcttctgctgctaaacagggtcaggtgaacccactgccagctgtgcccagaagacagtcccccaggctgagtcaaaagtggttcataggccggtcatggtggctcacgcctgtaatcacagcactttgggaggccaaggtgggcagatctcaaggtcaggagatcaagaccatcctggctaacacagtgaaaccccgtctctactaaaaaactac

SEQ ID NO: 293102 - DNA, 602 bp, Homo sapiens
attccgaaagaaacgtgtcaggcaagaagcgctagttcacgcctgtcattccaccgctttgggaggccaaggcagggggatcacttgccccagaagtttgagaccagcctgggcaacatagtgaggcccctgtctctacaaaaaacttaaaatcaataaacaggtctccttccttcctcaatagtcctgttggtggctcacctctctgcctctccagatgtgaggcagatccacacgtttagctattgagataaggctgggcgtggtggctcacacctgtcattccggcctcagatctcttgtgcccaggagttttaagactagcctgggcgacctggctggcaacatggcctccacaaaaataaataaaacattttaaatatataaacattgagataatagcatcttgatgcctgtcttcattttttgtcttctgttttaaggactattagagacaaactaaccaaagataattctcccctcccacgtggctcgtgctgggacgccggcaccgtgagatggcgcccgtggccagatagagggtggcgtgtaaagcaggtggcatcagataaacacccggtacagagctcgattcgtagata

SEQ ID NO: 293103 - DNA, 578 bp, Homo sapiens
ctgtatgtgtgtgtgtatgtgtgtagagactgggtttcgccatgttgcccgtgtgtgtgtgtgtgtgtgtgtgtgtgtttgtgtgtgtagagactgggtttcgccatgttgcccaggtgtgtgtgtgtgtaaagactgggtttccccatgttgcacaagctggtctattctcaaactactgagctcaggcaatctgcccaccacagtctcccaaagtgcttggattacaggcagaagccacagtgcctggccagcataaactattctaaatagctttttttatttaactaataaatctagacagattaaacattttagaggacctctaaaatactatgccctgtggaaaacaagacaaagcactaattccatacagcttgccttgggacagattctcccttcagtctcatctgtgtaatacttattattctcaaagaaagtgaacacatagagcgacatttaaattccaagatgtaacaaaaccttaatgttaacattaaaaaattaaaatctcagagtgtgccacaccataggtgcttaattaaaaaaaaacatactaaacagtgaaaatggatgac

SEQ ID NO: 293104 - DNA, 680 bp, Homo sapiens
ctgtatgtgtgtgtgtatgtgtgtagagactgggtttcgccatgttgcccgtgtgtgtgtgtgtgtgtgtgtgtgtctgtgtgtgtagggactgggtttcaccatgttgcccaggtgtgtgcatgtgtgtgtgtgtgtgtgtgtagggactgggtttcaccatgttgcccaggtgtgtgtttgtgtgtgtagagactgggtttcgccatgttgcccaggtgtgtgtgtgtgtaaagactgggtttccccatgttgcacaagctggtctattctcaaactactgagctcaggcaatctgcccaccacagtctcccaaagtgcttggattacaggcagaagccacagtgcctggccagcataaactattctaaatagctttttttatttaactaataaatctagacagattaaacattttagaggacctctaaaatactatgccctgtggaaaacaagacaaagcactaattccatacagcttgccttgggacagattctcccttcagtctcatctgtgtaatacttattattctcaaagaaagtgaacacatagagcgacatttaaattccaagatgtaacaaaaccttaatgttaacattaaaaaattaaaatctcagagtgtgccacaccataggtgcttaattaaaaaaaaacatactaaacagtgaaaatggatgac

SEQ ID NO: 293105 - DNA, 1104 bp, Homo sapiens
gcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggaaatga

SEQ ID NO: 293106 - DNA, 384 bp, Homo sapiens
gcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctgaggatccaaaaaaaaaaaa

SEQ ID NO: 293107 - DNA, 970 bp, Homo sapiens
gcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaacccagtccccttgacttcccttttgagagcacacgtactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggaaatga

SEQ ID NO: 293108 - DNA, 909 bp, Homo sapiens
gcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagccagtagtgggtcagccagtagtgggtcagccagtagtgggtcccagtagtaggtcagccagtagtgggt

SEQ ID NO: 293109 - DNA, 1274 bp, Homo sapiens
agcgagtcctccgccgtggccgaaggcggccgccatggcgccggcagtgccagcgggcgtcttgcgacccggctcgggcttcgccaccattcactgtgcttctcaagccacttcggcactctaatttcgccctgctctctctagacgatttttaatacctgggaaagttactccccagtctaacctaaaaaggtagaattgatggggtggggaattaacaggaaggcatgatcctcgaggataacgctgaccaggcgcttcttccaacaagcctgtttccctctctgtcgccaccgtaggagttcctacagctctcccgcacattctgtacggattgttttttagtcaagacgttctgtgcgagaggagaagttactttatgaacaccctaacaggggatcttacgacctcttccccgctctccactcagtccttttaaaaacgcgaggcaggatgaagaacgctattgaagtacattctaaaatgatcccacctgcaatttggatttttggagaatcgggatcggtgtaaaattctacatgcatacacgtatttgcacaagaatatttatagcaacgtggtttttaataggaaactatctaaatgttcattacaagtgaattacataaagctcaatacatccatactacgaatcactgaagagctgctaaaatagatgaaatatatttataatggcatgaacaaccgacacaagacagttgcagagtaatgtgtatttgtgattacatttatgtttttaagttatacaaacgcgtatgtgcctatgtgtatgtaaattcataggaagacaaatcagaggacggtggttacctggggaaaagcatgtgttgtcctagggtatagctttgcaggagagcttggcagagcctgccaaacctgatcagcttttccacctctcagctactgctttcggctccccagcctcataaactctcagctgccacattacaaatcagcagatgtcttgaggtgaaatgtggtgccaaatgtcaagctcaactttttggatcatctctcctgaatttcagttcctcgaatcctcactgtcctgggtctccaatgccttcaaaaaggattttagcaaaaaaagcaaaaatggaaaaattggataacatcaaacttaaaaacttctgcatgttaaagtaaataatcaacacagtgaaaaagcaagctatggaatgggagaaaacaattgcaaatcatatgtctgataagggattgatttccacaatatgtagagaactcttacaact

SEQ ID NO: 293110 - DNA, 367 bp, Homo sapiens
tggaagattgcggtatgttttgcgctttttattgtgatgctgaatccactttgtgtatttttcttgaagcagactggataagggataaatacaaataacaaacacgatcatgataactagcatagggtagatgctttaacaacattcaagtcaatgaatgagataattatgctctaagcattgtgttcctgttttcatttagactccagttttatcttagatattataacattttgaataacaaatttggttgatggtttaaatctttgtgagcatatttatagaaatcatgagtttccctttgtgttttcagatacactcacagaatattttccatttcctctctggctgggaaacatgtgtataa

SEQ ID NO: 293111 - DNA, 449 bp, Homo sapiens
tgcggccgccatcggcacggacttctggtatatcattgacaccgagcggctggagaggactggcccgggggcgcaggacctgctggggtccatcaatcgcagccagcccgagcctctgagctcccactccggcctctggcggacctgccgggagcccgtgcacaccgctgatgaaccccttcaggctggagaacgtgacagtcagcgaatcgagccggcaacttctcaagatagcgtcttgctgtgttgcccaggctggtctcaaattcctggcttcaagtgatcctcttgcttcagcctcccaaagtgctgggattacaggctgtacaagaagcacagcagcttctgcttctggggagccctcaggaaacttacaatcatggcggaaggtgaaagcccgaactctcatcttgatcgcgatacaaaataaatattggctctatcagaac

SEQ ID NO: 293112 - DNA, 356 bp, Homo sapiens
tgcggccgccatcggcacggacttctggtatatcattgacaccgagcggctggagaggactggcccgggggcgcaggacctgctggggtccatcaatcgcagccagcccgagcctctgagctcccactccggcctctggcggacctgccgggagcccgtgcacaccgctgatgaaccccttcaggctggagaacgtgacagtcagcgaatcgagccggcaacttctcagctgtacaagaagcacagcagcttctgcttctggggagccctcaggaaacttacaatcatggcggaaggtgaaagcccgaactctcatcttgatcgcgatacaaaataaatattggctctatcagaac

SEQ ID NO: 293113 - DNA, 212 bp, Homo sapiens
cagattttcagtgcctcacttatactaggaaacaaaaacagctagagctgttatgaattcaactttacttctcatctacatgaggctgtacaagaagcacagcagcttctgcttctggggagccctcaggaaacttacaatcatggcggaaggtgaaagcccgaactctcatcttgatcgcgatacaaaataaatattggctctatcagaac

SEQ ID NO: 293114 - DNA, 1040 bp, Homo sapiens
tgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctggccggcggcaccatgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgttgacccctttcccccaccccagagttgggatgcggggcagagccaccagggcactgtctgcgtgactattttttaataaaagtactgaagacccgttggcttttgtcgtagaggcagggcagtcacagcagcgtgggaacccgtgggaaggtggggcccccgggccagcgggaggggaacaaaatgctgtggggggctccgagacagcggctttcagccaggtcagccaggtgcatgtggaccccaagggtccccaaatccccaggacctcagaggtcccggcaccaccgccccgccctcggccctcttcccagggcgctgggctcaccagttcgctcc

SEQ ID NO: 293115 - DNA, 1291 bp, Homo sapiens
tgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctgtgagtggctcagagcgtccgcccagcctccccctgcaccaggactccgctcagctcagccaccacgctcctccggggagggaggctgggtggaagggatggaacagcactggcgcagtggctggggctggagggcaggctgcgggcattgggcggcggccggaggggtcgccgggcgagcgcggggaggggagcggcggcctgcagctgtcccaggcgcacctcaccctgcgctgcccctgtgtgtccagggccggcggcaccatgaggcaggcgggacgcgcagcgctgctggccgcgctgctgctcctggtacagctgtgccctgggagcagccagaggagccccgaggcggccggggtccaggacccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgttgacccctttcccccaccccagagttgggatgcggggcagagccaccagggcactgtctgcgtgactattttttaataaaagtactgaagacccgttggcttttgtcgtagaggcagggcagtcacagcagcgtgggaacccgtgggaaggtggggcccccgggccagcgggaggggaacaaaatgctgtggggggctccgagacagcggctttcagccaggtcagccaggtgcatgtggaccccaagggtccccaaatccccaggacctcagaggtcccggcaccaccgccccgccctcggccctcttcccagggcgctgggctcaccagttcgctcc

SEQ ID NO: 293116 - DNA, 1017 bp, Homo sapiens
tgcgtccagtgctgcttccagcgctagccccaggggcacgaaggctggtgtagggaggtgcgcccctccgggggcccgccagccgtcagactcgaagctgtggctgtcattgcttctacaatcagtgcatgttcttcgctgacgtcagtcggagctgtcctggcactatataaggctggcgacagccccgggacagaccctgtgttccccaaggcgtcttcagcctgccccgagggacagagactggagctcaatcttggaccgtacagacgctcgccgacaacctggccggcggcaccatgaggcaggcgggacgcgcagcgctgctggccgcgctgctgctcctggtacagctgtgccctgggagcagccagaggagccccgagtctgcgctggagccccggggcacggaaccagggtggcggggcccgcgcgctcctcttgctgctggcggagcgcttcccgcgccgcgcggggcccggccgattgggactcgggacggcaggcgagcggccgcggcgggacaacccttctctgtccattgacctcacctttcacctgctgcggaccctgctggagctggcgcggacgcagagccagcgggagcgcgccgagcagaaccgcatcatattcgactcggtgggcaagtgatggcccggtttggggctgcgaaaacgttgacccctttcccccaccccagagttgggatgcggggcagagccaccagggcactgtctgcgtgactattttttaataaaagtactgaagacccgttggcttttgtcgtagaggcagggcagtcacagcagcgtgggaacccgtgggaaggtggggcccccgggccagcgggaggggaacaaaatgctgtggggggctccgagacagcggctttcagccaggtcagccaggtgcatgtggaccccaagggtccccaaatccccaggacctcagaggtcccggcaccaccgccccgccctcggccctcttcccagggcgctgggctcaccagttcgctcc

SEQ ID NO: 293117 - DNA, 682 bp, Homo sapiens
gctaagaacggcggcggcagcagtagccgcagctccccggtgtctggcccccctgccgtttgcgagaccctggccgtcgcctccgcctccccaatggcggcggcggcggagggcccccagcagagcgcagagggcagcgcgagcggcgggggcatgcaggcggcagcgcccccttcgtcgcagccgcacccgcagcagctccaagagcaggaagaaatgcaagaggagatggagaagctgcgagaggaaaacgagactctcaagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaaaaggaagcaaagatttgc

SEQ ID NO: 293118 - DNA, 711 bp, Homo sapiens
tcagtaacgcgaggttttcatttaaattcaaatctgggcctccgtttctctaattataatggtttgtcacacttcttcctggagagaggtagagtaagagaacgagagagggcctaaagtgggcctttttcccccagtttcctcttctgtactcagctccttgtcactcctgtctcgtggagagagagggcaattaaagctgagaatttggaattggaatggggtgtgtacggtgtgtgtcggaagggctggaagcgagtttgattttgacacgcggcctgtcaccgcctcagaacgagatcgatgagctgagaaccgagatggacgagatgagggacactttcttcgaggaggatgcctgtcaactgcaggaaatgcgccacgagttggagagagccaacaaaaactgccggatcctgcagtaccgcctccgcaaagccgagcgcaaaaggctccgctacgcccagaccggggaaatcgacggggagctgttgcgcagcctggagcaggacctcaaggttgcaaaggatgtatctgtgagacttcaccatgaattagaaaatgtggaagaaaagagaacaacaacagaagatgaaaatgagaaactgaggcaacagctcatagaagttgaaattgcaaagcaagctttacagaatgaactggaaaaaatgaaagagttatccttaaaaagaaaaggaagcaaagatttgc

SEQ ID NO: 293119 - DNA, 909 bp, Homo sapiens
gtctatggtggtgagggctgcgcggggagaccgggagacacgcgccgggcgggccctgagcctctccgccaggctcgcagctaggacgtcagagcccgggggagagaagctcctccgagctgtgcgcgccgcaccctcccggcgcggggaacccgaggggtagcgtgggtgccacggggctcacctggcagcgctgtgggctcggcgtccgggggatcctcgtacaccgacaccgggctcccgcctgtgcatccggggaagaacttccgcggaggagcgaactggccgggcacacaaacgttgaacgcgggtcagccctcggggcaccgagcgcgcagaccccgcccggcccgaatcaaccgccccaccttcctctccggcttccccggcttgcagagcagcgcccggcccggcagtgccagcattctgttggggcagatgctgtcgaaggcccgacggccggccgcgccgcccccgcacgcctgcattgtgcctcctgcctccgggtgccgactgctcggaggcggcggcccgggctggggcagcgatccacaccctgcactcccttcagtgcctgcaggctccgaagccagccagaggttggggcaggcgcgtgaccgagaaggagccgaggggctgccgaggagccacaaggcgcacgaaataaacgtggagtgacacccgccagcgctagactccggcctttgcgctcctgcaggatttagtaaggatgtagaataccggcagggatgccctggaacagcccccttattacagaagccccttccctcaaacctgaaccttatcctgggtcctgacttatggatttccacgtggtctcttttggcctgacgccaagagcccgccccgctccccaagccccgcactcttctcggcagtggcgcgtga

SEQ ID NO: 293120 - DNA, 1731 bp, Homo sapiens
gctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccaaacactcagctttgtcttcttatcttactgaagacattttgccagagcagggcctgcaagtttcattccaaaaagtgatgctgagaagatatgaaagatgttgtcttgagaaattacgcttaaggaatgactgggaaattgtgggtgagtggaaagggcagaaggcaagttataatggacttgacctatgctcagcaactactcatagcaaaaactttcaatgcaataaatgtgtgaaaggttttagtaaatttgcaaatctaaataaatgtaagataagccatactggagaaaaaccattcaaatgcaaagaatgtggcaatgtctcttgcatgtctttaataatgactcaacagcagagaatccatattggagagaacccgtaccaatgtaaaaaatgtggcaaagcctttaatgagtgctcatgctttactgactgtaagagaattcatgttggagagaaacattgcaaatgtgaagaatgtaataacatttttaagtcttgctcaagtcttgctgttgttgagaaaaatcatactgaaaagaaaacctacagatgtgaagaatgtggcaaagcttttaacctgtgctcagttcttactaaacataagaaaattcatactggagagaaaccatacaaatgtgaagaatgtggcaaatcctttaagttgttcccataccttactcaacacaagagaattcatagtagagagaaaccctacaagtgtgaagaatgtggcaaagtctttaaattgttgtcataccttactcaacatagaagaattcatactggagagaaaaccttccgatgtgaagaatgtggaaaggcctttaaccagagctcacatctgactgaacataggagaattcatactggtgagaaaccatacaaatgtgaggaatgtggcaaagcttttacctggttctcataccttattcagcataagagaattcatactgggcagaaaccctacaaatgtgaggaatgtggcaaagcttttacctggttttcataccttactcaacataagagaattcatactggagagaaaccctacaaatgtgatgaatgtggcaaagcttttaactggttttcatatcttactaatcataagagaattcatactgaagaatgactaagacctactattcgatagcacaacagggtgactacagtcaataataatttaattgtagattttaaaataaccagaagagtataattggattgtttgtaacacaaaggatgcttgaggggatggacaccccattttccctgatgtaattattatacattgtatgcctctatcaaaacatctcatgtacctcatgaatatatacatgtacacacaaaaatt

SEQ ID NO: 293121 - DNA, 1031 bp, Homo sapiens
cggtgcgtctccgctgctccttccccttatccctgggaggtccaagtggtcccgcggcagcttctgttgctctgggacctgcaggtcccggaaggtccttagggaggaccccagacaccggagactgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccaaacactcagctttgtcttcttatcttactgaagacattttgccagagcagggcctgcaagtttcattccaaaaagtgatgctgagaagatatgaaagatgttgtcttgagaaattacgcttaaggaatgactgggaaattgtggtagagacggggtttcaccgtgttagccaggatggtctcgatctcctgacctcgtgatccgcctgtctcggcctcccaaagtgctgggattacagacgtgagccactgcacccggccagcataagatttttatatgagtaattgggaaggcttctataaatataagccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccacagaatctatttctgatgaatatgaaaggaagattgttcttccatgttggtttttattgagatatctctttttttcccttttcatttggtgtcctaactccatgaatagaaaagaaaatgtattaatt

SEQ ID NO: 293122 - DNA, 879 bp, Homo sapiens
  misc_feature (655)..(655): n is a, c, g, or t
gctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccaaacactcagctttgtcttcttatcttactgaagacattttgccagagcagggcctgcaagtttcattccaaaaagtgatgctgagaagatatgaaagatgttgtcttgagaaattacgcttaaggaatgactgggaaattgtggccatgtgaagatgtgcttgcttcccctttgccttctgccatgattctaagtttcctgaggcctccccagaagcagaagcatgtaaagcccacagaaccggtcagtcgtcgacatcgagctgtttgaagacctgcggangtccgtcgtgcttgacacagtgctggatcctgtcgtgagggattacacggtccagtggtcaccagtttgataaaatgctcccaaaaaaaaaaacgggtttttcggggggaaagatgaggcctggctaggtcgaccttgaagggaagcggccagggtatgactcgtattagaggagtggtgattcgcagcagttctctttcgtttgagacattctgacgtaaagc

SEQ ID NO: 293123 - DNA, 609 bp, Homo sapiens
gctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccaaacactcagctttgtcttcttatcttactgaagacattttgccagagcagggcctgcaagtttcattccaaaaagtgatgctgagaagatatgaaagatgttgtcttgagaaattacgcttaaggaatgactgggaaattgtggccatgtgaagatgtgcttgcttcccctttgccttctgccatgattctaagtttcctgaggcctccccagaagcagaagcatgtaaagcccacagaacccgtgagttgattaaatctcttttctttata

SEQ ID NO: 293124 - DNA, 759 bp, Homo sapiens
gctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccaaacactcagccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgcgtcagcccgagttctgaattaaaacatgcctcccacagaatctatttctgatgaatatgaaaggaagattgttcttccatgttggtttttattgagatatctctttttttcccttttcatttggtgtcctaactccatgaatagaaaagaaaatgtattaatt

SEQ ID NO: 293125 - DNA, 829 bp, Homo sapiens
cggtgcgtctccgctgctccttccccttatccctgggaggtccaagtggtcccgcggcagcttctgttgctctgggacctgcaggtcccggaaggtccttagggaggaccccagacaccggagactgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccaaacactcagagtctcagctctgtcacccaggttggaatgcaatggtgcgatctcggctcactgcaaactgcgtcccgggttcaggtcattctcctgcctcagcctcctgagtagctgagattacaggcatgtgccaccgtgtctttttagtagagacggggtttcaccatgttggccaagctcgtctttaactcataacctcaggtgatccacccacctcagcctcccaaggtgctgggattacaggcatgagccactgcgcgtggccataatgtattttaaaatcagaaagtatgatacctgcaacattgttcttctttgtggagattgttgcgctcttcatggttccttcacgcactgtgtaattttagggttgccttttctatttctgcaaaaacgaaattgtgaacttgagaggattgcactgaatctgtaggtcacttgggtg

SEQ ID NO: 293126 - DNA, 868 bp, Homo sapiens
cggtgcgtctccgctgctccttccccttatccctgggaggtccaagtggtcccgcggcagcttctgttgctctgggacctgcaggtcccggaaggtccttagggaggaccccagacaccggagactgggaaatgggactattggcattcagggatgtggctctagaattctctccagaggagtgggaatgcctggacccagctcagcggagtttgtatagggatgtgatgttagagaactacagaaacctgatctcccttggtcttgctatgtctaagccagaactgatcatctgtctggaggcaaggaaagagccctggaacgtgaacacagagaagacagccaaacactcagctttgtcttcttatcttactgaagacattttgccagagcagggcctgcaagtttcattccaaaaagtgatgctgagaagatatgaaagatgttgtcttgagaaattacgcttaaggaatgactgggaaattgtggccatgtgaagatgtgcttgcttcccctttgccttctgccatgattctaagtttcctgaggcctccccagaagcagaagcatgtaaagcccacagaaccggtccagtcgtcgaccatcgagctgctttgaagaccctgcggaggttccgtcgctgcttgaacacagtgcctggactccctgctccgtgaggcgaatttacaccgggtccagctgggtcagcccgagttctgaattaaaacatgcctcccacagaatctatttctgatgaatatgaaaggaagattgttcttccatgttggtttttattgagatatctctttttttcccttttcatttggttgtcctaactccatgaatagaaaagaaaatgtattaattc

SEQ ID NO: 293127 - DNA, 726 bp, Homo sapiens
aaccctacaaatgtgaggaatgtggcaaagcttttacctggttttcataccttactcaacataagagaattcatactggagagaaaccctacaaatgtgatgaatgtggcaaagcttttaactggttttcatatcttactaatcataagagaattcatactgaagagaaaccctacaaatgtgaagaatgtggcaaagcctttggccagagctcacacctttctaaacataagacaattcataccagagagaaaccatacaagtgtgaggaatgtggcaaagcctttaaccactctgcacaacttgctgtacatgagaaaactcatacctgagaaaaaccctacaattctaaacaatatggcatagtctttaatacctattcacaacttcacagcagaatatttttactgaataagagtgttacaaatgtaatgactgtcaaaaggccatttacagtctatgagcctttgagtgcactaaaatgtttaggctacgaacaatacaaatagaccggttcaacacctccacttatatcacagctcttactgtacacagaagaatttatactggagggaaaccctccagttgctcaaactgtattcaatttcaaagactttgtattggagagaaaccctacaaatgtaataaatgcagaaacaacatttgttcaaaaaatatacctcagaaaacaccagagtgttcacactaaaaactgttttacagatg

SEQ ID NO: 293128 - DNA, 490 bp, Homo sapiens
tttctacccttccctttcctgataaagtcccacatagtctctacaattcaggtcaaaatgctacatctcctgtgaagcctctcttgatttccacagaggaactctggggccatgtccttccctctccaccacagaccacacctgcttgtagcactgtcactaggtggcttagtgcctgcttatcagcatccatctggctctctgtgttatcatctcatcaagaacaagaatccaatcttacttctctaagcatccccagctcccaggagagtgtctggaccatgatgataggtgtatgcatatgttggataaaacaaaaatcaaattcctttattccagttatctgaaaagtttttaccctccaatctcgactgttcattctgatccaggctaatgtcaatcttgcctcatagcaactctacctgtcctcttacttgtttttaccagacaatatggaagtaactaattaattttaagaaaaatttccctt

SEQ ID NO: 293129 - DNA, 519 bp, Homo sapiens
gcggccgccgaggggacgcctcgcgacggttcctgggagagctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtgccggggacacgggcggcaagccgtccacgcggggcggtgaccctgcagcgcggtcccgca

SEQ ID NO: 293130 - DNA, 512 bp, Homo sapiens
gcggccgccgaggggacgcctcgcgacggttcctgggagagctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtaaggacagggctgtgcttatgcctgcctgggtgtgacctgccatgctcatcctg

SEQ ID NO: 293131 - DNA, 370 bp, Homo sapiens
cggccgccgaggaggtgaggagcggcggcgggcgcgggaggagaagaggctgagggcgggagcctggtgctgagagcccagggccgggagggcgggagcgggctcgggcctgggaggggagtgcgagtgcagggctggggactggaccctggggagggaggtgcgggttcagcgccgggggacgggcccctggggaggggtgcggggccgggggaccagaccctggggaggggcttaaggggctggaggacgggaccctgggaagtggggtacagggctagaggtcgggactctagggagggagcctgggtcgggcgcacgggccgggcggggcgcgcggtgggggagcgacgggtggagggtggggtgg

SEQ ID NO: 293132 - DNA, 463 bp, Homo sapiens
tctggagctctgatgtacaacatggtgattacagctattaatgcatacttaagaactggaaagagtgggctttaaatgttctcaccacaaaaaaatctccctccggggacctctgagacgtttctccaggacaaggaacagcacgaacatgtcagcctgcgtggatgaaaccgggaagatggccgcgagccgtgtgcccacacaggagtgtggccatggctgtcggtgtgaggctgtagctctgtggaaaacgcagaccacacagtacagaggcgaggccgtctccagagctggcatcatcaatgtggctaccatcgggcaaggccagaagaaaatacggaaaataggaaaatcgctgctggactcatgtccttgggccttcagcaaattttctcctttaaaaatttcctttaatactgtgtaatgttgcttttgcgaaaataaaattcccgggacaaaaaaa

SEQ ID NO: 293133 - DNA, 780 bp, Homo sapiens
cacacagccagtgtatccttcagcaagcctcttttaatgatttaaaaaagaactactaacttttacaaataattgtgttcagagacagactttcaatctaaagaaaagatcaaggacctagctctcgtggcagaatgcagaaacagaagcctccagattgatctctgcagatgctaacgtggcccactttgtcctcatattcagcctgatcctaaagcccttacaactaagccaatacctgcttggattcttctgacaactggcaaagatgtcacgttccacttcttatctcaccacctcttaaccacaaattggccccagtggctttcaaaagggggaaaaaattgtgcgagtttgagactgtttatgtattcatgactaaaaccaaatctgagatctttggaactcttagctggccctggggcatgcgagccgcctgtgcatccctttggtccacctggaggcccgtgaagaccttcagtggaaggaagagtgggtcagatgagacgtgtccatttcatcagtcagccatcggtgacaggctgaattcagagacccaggccagagtgtaccagctacaaaatttatccaaggattccaattatgctttaaaaaattctaccagaagaagtaaaaaacgatgtttatatgttaagaaatgtaacagagtagctctcatttgataatataaaatagctctgcctctattcaaaacagttgattttaaaagtaggtatatagtcgctatacttattattatttttagattgctttaaaaag

SEQ ID NO: 293134 - DNA, 412 bp, Homo sapiens
aagacgagaatacatggtaggtatattttccttattaattttaaagtttacaaagcaaagattgatttcaaccaagctgtttcatgttatacattctaaataatatgagatgtgagctaataagttttttgtgtatattaccttattgattgaaacatgtgacccaacttttagcattaaatgtaaaaattattgcagaagactgctaaatcttctcttttccattataggtttttctgttcatgcatctcagggtgtattctaagatgggaaactgtttttaaagttttagattaatacagggtcctgtggttctcaaaattgcttggttaacaagaatacctagatatgatgttattaatcatatcaaatgtttttctgttaaaaatattaaaataactataaaatgtgc

SEQ ID NO: 293135 - DNA, 4184 bp, Homo sapiens
ggtgtactggtccggaattttgggatcgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcactttgggaggctgaggcggttggatcacttgaggtcaggagtttgagaccagctggccaacatggtgaaacagcgtctctactaaaaatacaaaaatttgccgggcgtggtggcgcatgcttatagtctcagctactcaggaagctgaggtacgagaatcacttgaacccaggaggtggaggttgcagtgagctgagattgtgccactgcactgcagcctgggcaacagagcaagactctaaaaaaaaaatggtttatcaatatttactattgaaatatttgtccaggtaactttacacttacaatgaattcatggattttgttagcagcattggctttctcaaaaggacaaactcaatatcgttataaaatataattcgtgatcacaaattatacaaaaatcagtagaaacagttttttatgttcagattaaaaaaaaaaacttgggataattttagatttacagaaaagttgcaaagatacatggagagcttctgtgaccactcacccagttcccccagtgttaaccttttatttaaccatgaagcatttgtcagaagctaagtaaccagcaatggcaattactattaacggaactttgactttatttttcagattgtactagttttttaattaatgtcatttttcttttccaggatccaatctaggataccacactgaattagtcgtcatgcctaattagcctctggtctgtgatagttccacagtctttctttttcataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaaccccctggaagtgggaatatccatatgtagtatttggaatttttctatatggaaaatttgtttctccctcccaccctaatttgtttacatcagtatggactcatgtatattttgtattttgggtaacacagtatttattttgttgcttaagttgtccagcttggctattaggagttctgccaggttggctactatgtccctttgatgtgcccatccttttgatttttgagcacttcttactttctggcactacaagatgctccaggttcatcttggatattccctgccccaaccctagaatccctagaatcaacccctgctccaaagagccctggttccttttgttggagaatcatacttagaaaccaagatctgggcattagatgtgcttgttgctactgggatgtcactgtttgtagcagagttgagaaatatgtatgtatattaatccatgcatatgtacacatctataattatttatgtgtgtacaaagctaaacatgagtttgtactgccgtcttcaactcaaaatttgtcccaaaattttgtggcatatgtttagattttaaagttgatattttccctattgacagaataaactcattaaaagagcaaaaaaaaaaaaaaaaaaa

SEQ ID NO: 293136 - DNA, 4169 bp, Homo sapiens
cgatagctaggtacgagcccttcgtgtaaatcggccgaggccagctagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcactttgggaggctgaggcggttggatcacttgaggtcaggagtttgagaccagctggccaacatggtgaaacagcgtctctactaaaaatacaaaaatttgccgggcgtggtggcgcatgcttatagtctcagctactcaggaagctgaggtacgagaatcacttgaacccaggaggtggaggttgcagtgagctgagattgtgccactgcactgcagcctgggcaacagagcaagactctaaaaaaaaaatggtttatcaatatttactattgaaatatttgtccaggtaactttacacttacaatgaattcatggattttgttagcagcattggctttctcaaaaggacaaactcaatatcgttataaaatataattcgtgatcacaaattatacaaaaatcagtagaaacagttttttatgttcagattaaaaaaaaaaacttgggataattttagatttacagaaaagttgcaaagatacatggagagcttctgtgaccactcacccagttcccccagtgttaaccttttatttaaccatgaagcatttgtcagaagctaagtaaccagcaatggcaattactattaacggaactttgactttatttttcagattgtactagttttttaattaatgtcatttttcttttccaggatccaatctaggataccacactgaattagtcgtcatgcctaattagcctctggtctgtgatagttccacagtctttctttttcataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaaccccctggaagtgggaatatccatatgtagtatttggaatttttctatatggaaaatttgtttctccctcccaccctaatttgtttacatcagtatggactcatgtatattttgtattttgggtaacacagtatttattttgttgcttaagttgtccagcttggctattaggagttctgccaggttggctactatgtccctttgatgtgcccatccttttgatttttgagcacttcttactttctggcactacaagatgctccaggttcatcttggatattccctgccccaaccctagaatccctagaatcaacccctgctccaaagagccctggttccttttgttggagaatcatacttagaaaccaagatctgggcattagatgtgcttgttgctactgggatgtcactgtttgtagcagagttgagaaatatgtatgtatattaatccatgcatatgtacacatctataattatttatgtgtgtacaaagctaaacatgagtttgtactgccgtcttcaactcaaaatttgtcccaaaattttgtggcatatgtttagattttaaagttgatattttccctattgacagaataaactcattaaaagagcaaaaaaaaaaaaaaaaaaa

SEQ ID NO: 293137 - DNA, 4299 bp, Homo sapiens
ggtgtactggtccggaattttgggatcgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcactttgggaggctgaggcggttggatcacttgaggtcaggagtttgagaccagctggccaacatggtgaaacagcgtctctactaaaaatacaaaaatttgccgggcgtggtggcgcatgcttatagtctcagctactcaggaagctgaggtacgagaatcacttgaacccaggaggtggaggttgcagtgagctgagattgtgccactgcactgcagcctgggcaacagagcaagactctaaaaaaaaaatggtttatcaatatttactattgaaatatttgtccaggtaactttacacttacaatgaattcatggattttgttagcagcattggctttctcaaaaggacaaactcaatatcgttataaaatataattcgtgatcacaaattatacaaaaatcagtagaaacagttttttatgttcagattaaaaaaaaaaacttgggataattttagatttacagaaaagttgcaaagatacatggagagcttctgtgaccactcacccagttcccccagtgttaaccttttatttaaccatgaagcatttgtcagaagctaagtaaccagcaatggcaattactattaacggaactttgactttatttttcagattgtactagttttttaattaatgtcatttttcttttccaggatccaatctaggataccacactgaattagtcgtcatgcctaattagcctctggtctgtgatagttccacagtctttctttttcataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaaccccctggaagtgggaatatccatatgtagtatttggaatttttctatatggaaaatttgtttctccctcccaccctaatttgtttacatcagtatggactcatgtatattttgtattttgggtaacacagtatttattttgttgcttaagttgtccagcttggctattaggagttctgccaggttggctactatgtccctttgatgtgcccatccttttgatttttgagcacttcttactttctggcactacaagatgctccaggttcatcttggatattccctgccccaaccctagaatccctagaatcaacccctgctccaaagagccctggttccttttgttggagaatcatacttagaaaccaagatctgggcattagatgtgcttgttgctactgggatgtcactgtttgtagcagagttgagaaatatgtatgtatattaatccatgcatatgtacacatctataattatttatgtgtgtacaaagctaaacatgagtttgtactgccgtcttcaactcaaaatttgtcccaaaattttgtggcatatgtttagattttaaagttgatattttccctattgacagaataaactcattaaaagagcaaaaaaaaaaaaaaaaaaacctcaggggggccgtacccatttgcctataggatcgataccattatggcgcgttacacgttggactggaaacctgcttcccaactatgcctgagcattcccttgcgttgcgatcc

SEQ ID NO: 293138 - DNA, 4107 bp, Homo sapiens
ggtgtactggtccggaattttgggatcgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacgcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctagaaggaacggactttttttttctattttaattacacataatatgtaattaaagtacaacataatatgttgtttctctgtagcccgttgagcatatgagtaagtcacatttctattaggactacttacaaggacaaggtttccatttttccagttgtaaaattggaaccatcagctgataacctcgtagggagcaaccccaggatagctaagtgttatgtaatatgcctagaaggtgatgtgaatgcgattcagaagcatagccactcccattttatgagctactcacatgacaaatgtcatcttttgctataacctttgccaagttagagaaaagatggatttaatgagataaatgaaaagatatttaacctaatatatcaaggcactatttgctgttatgctttgttatttatttcccagcacttgttccttattgtagattttttaaagactgtaaccttttactaactgtggtcttactaaaatttgtgcttgatactgcttttcaaaaagcctttaattagagccaaaaggatggaaaaggcaagatataaatgccttttatagatctcttatttacattgaaaattattaccatatgtttagagcaaatccaagaaaacttcaacagcttctgaagatgtctatgaatgttgaaaacttttcaatctcttggaatgctcagttatgttcctagaccggtctttgctgactactggttgttaacctttccctagcctgggacctcaagccatatatatcctttgggtgacccatggccaaagttattaagatgaactgactttcaaagtcagagaaggacagcatagggagaggcggttatttgtaagtcattacaggtagaacagggcagaaggaaaagtatgttctggagaaagggccatgttcctaactttggagatatgtcattgccgggaacctagtatcttccaacttgaattggtggcagctgttccagtgagacaaggcacatgtatgccttgtggctaagtgagcaaactgggtttccacttaaatgtttgggaccctcaattgattctttatttcaaacctttataaaaggtacagttttgtaagccattattaataattaatgcttatcggctgggcacagtggctcacacctataatcccagcactttgggaggctgaggcggttggatcacttgaggtcaggagtttgagaccagctggccaacatggtgaaacagcgtctctactaaaaatacaaaaatttgccgggcgtggtggcgcatgcttatagtctcagctactcaggaagctgaggtacgagaatcacttgaacccaggaggtggaggttgcagtgagctgagattgtgccactgcactgcagcctgggcaacagagcaagactctaaaaaaaaaatggtttatcaatatttactattgaaatatttgtccaggtaactttacacttacaatgaattcatggattttgttagcagcattggctttctcaaaaggacaaactcaatatcgttataaaatataattcgtgatcacaaattatacaaaaatcagtagaaacagttttttatgttcagattaaaaaaaaaaacttgggataattttagatttacagaaaagttgcaaagatacatggagagcttctgtgaccactcacccagttcccccagtgttaaccttttatttaaccatgaagcatttgtcagaagctaagtaaccagcaatggcaattactattaacggaactttgactttatttttcagattgtactagttttttaattaatgtcatttttcttttccaggatccaatctaggataccacactgaattagtcgtcatgcctaattagcctctggtctgtgatagttccacagtctttctttttcataaccttgacagttttgaggagtactggtcaggtgttttgtagaatattcctcaatttgggtttgtctgatgttttcctcatggttagagtggggttatagatttttaggaagaataccagaggtgaaggtccttctcactgcatcatgtcaggagttacatgctatcagcttgatggtgtattaactttggacacttggttaaggtagtgtgtgttggttttttgctgctgaaaattactgttattttccctttccatacttctgttctttggaaaacagtcactaagtccagtcatgggaggtggtgggtgggaaagattacattcaaccccctggaagtgggaatatccatatgtagtatttggaatttttctatatggaaaatttgtttctccctcccaccctaatttgtttacatcagtatggactcatgtatattttgtattttgggtaacacagtatttattttgttgcttaagttgtccagcttggctattaggagttctgccaggttggctactatgtccctttgatgtgcccatccttttgatttttgagcacttcttactttctggcactacaagatgctccaggttcatcttggatattccctgccccaaccctagaatccctagaatcaacccctgctccaaagagccctggttccttttgttggagaatcatacttagaaaccaagatctgggcattagatgtgcttgttgctactgggatgtcactgtttgtagcagagttgagaaatatgtatgtatattaatccatgcatatgtacacatctataattatttatgtgtgtacaaagctaaacatgagtttgtactgccgtcttcaactcaaaatttgtcccaaaattttgtggcatatgtttagattttaaagttgatattttccctattgacagaataaactcattaaaagagcaaaaaaaaaaaaaaaaaaa

SEQ ID NO: 293139 - DNA, 1324 bp, Homo sapiens
ggtgtactggtccggaattttgggatcgcaggcgcacaggggacggttgctggcccaggtgagcgggcgcgctggtccaggtgagcgggcgcgtccccgcgacggcgctgcctgcccgaggcggttcacgtaaagacagcgagatcctgagggccagccgggaaggaggcgtggatatggagctggctgctgccaagtccggggcccgcgccgctgcctagcgcgtcctggggactctgtggggacgcgccccgcgccgcggctcggggacccgtagagcccggcgctgcgcgcatggccctgctctcgcgccccgcgctcaccctcctgctcctcctcatggccgctgttgtcaggtgccaggagcaggcccagaccaccgactggagagccaccctgaagaccatccggaacggcgttcataagatagacacgtacctgaacgccgccttggacctcctgggaggcgaggacggtctctgccagtataaatgcagtgacggatctaagcctttcccacgttatggttataaaccctccccaccgaatggatgtggctctccactgtttggtgttcatcttaacattggtatcccttccctgacaaagtgttgcaaccaacacgacaggtgctatgagacctgtggcaaaagcaagaatgactgtgatgaagaattccagtattgcctctccaagatctgccgagatgtacagaaaacactaggactaactcagcatgttcaggcatgtgaaacaacagtggagctcttgtttgacagtgttatacatttaggttgtaaaccatatctggacagccaacgagccgcatgcaggtgtcattatgaagaaaaaactgatctttaaaggagatgccgacagctagtgacagatgaagatggaagaacataacctttgacaaataactaatgtttttacaacataaaactgtcttatttttgtgaaaggattattttgagaccttaaaataatttatatcttgatgttaaaacctcaaagcaaaaaaagtgagggagatagtgaggggagggcacgcttgtcttctcaggtatcttccccagcattgctcccttacttagtatgccaaatgtcttgaccaatatcaaaaacaagtgcttgtttagcggagaattttgaaaagaggaatatataactcaattttcacaaccacatttaccaaaaaaagagatcaaatataaaattcatcataatgtctgttcaacattatcttatttggaaaatggggaaattatcacttacaagtatttgtttactatgaaattttaaatacacatttatgcctaga

SEQ ID NO: 293140 - DNA, 1301 bp, Homo sapiens
gcagctgggaggaccctcccgccccaggcagaggtgggggatatccgggagttcatttctgacctcctcgctcttcagcacctccttgaactcccgcttgattcgctgcaccgcgatgttggccatgtctccgcccgcagctgattcgtacccgcctcctccgccaccgctacgaccaccgccaccgccgccacctcttcctccaccgcctcctccctcggcgattcagacctgagcacacgaacactgccactaccaccccggccgccgcgctcgcctcagtgtggaatcacctccgcgcccggccaccaaaatggcgccgggtcggcgcatgcgcacgacgttgacccggccgggcggcgcagccgctcctgttggagcccccatacgcccgagccacgagctcgcgtctcggctggggctgcggccgcgtggctccgccctgccggcgtctggggccgcgagggtgcggcttccaagctggccggccctagccggcccccccggcccttcccggcgcctccgctcctgtttaaacccgggtgctgtggtctgggcttccagcgctggcctctgaccgaaggttcgggcgcaaccgaacgggtttccgacgccgcactcggctggaacgccgccctgactcagctagacccggaacccggaggctgaacgccgtgtctagcgcaggaaaacgctctcccggatctcggtccggcccattttcagttggtgtagccccagaaaatctactgcagtcgtttttgttctgcaacatttatagtaccacgattattcccatcatctcaggtagcacagattattgaattaaggctggttattgttggatcagattgggtttgagacaggtactcggtggagaggcctgagggtgggtttagaagccagatgttgctctttgacctatttaataccgagcttgacacacacacacaatctctctctctctctctctctctcacacacacacacacacacacacactcactcctatgcccatccctagagtgtagggtgggcctaagactgcgcttctaacaagtctcccagttgctgctgctgttggtgctggttccgggaccacattatgagaaccactgaactgaatgaagcatgtgaaaattcacatatattaaagtgaaaattggagaaatggaaacaattacagtacccttcaggggactcggggtgggggagggggagccttatttctgtaaacctaggcctcaaaggtgcctggtgatagtaggcactcaataaatattgaatgagtaaatgagtac

SEQ ID NO: 293141 - DNA, 174 bp, Homo sapiens
ggtctggggccttccacagagacacaaagctgaaccattgagggctgtgggccacagcaaacaagccagagggcttcctagacaggctgccagatttagcaaaacgacccaagacacccagttaaatgtgaatattttatttacttattttttttttttagagatggggtcttg

SEQ ID NO: 293142 - DNA, 833 bp, Homo sapiens
acagtgaatttgatttgctcttatgcttctatttttaattctaaactttccaggagtgtgacaagacacttatctagtaagaaaacagctttatccactttaactaattgtgcttagcatcaagttggattaccacttcagtgacctgaggttattcataattggactgatttctagctgggacatgagtccagggggctgtgtctacccagaataactgtccccagcagaggctgcatttggaactcaagggaaagttcattcctccaggcttttgcttcttaaggggtattagacttgctagttaaaaggcagatttctaggtccccctccagatctgctaaatcaggatttctggggacctgacccaggagactatttttttgtttttgagacagagtcttgctctgtcacccaggctggaatacagtggcacaatctgggctcactgcaaccttcacctcctgggttcaatctcgtgcctcagcctcccaagtaactgggattacaggcgcctgccaccatgcccagctaattttttttatttttttattttttgagacggaatctcgctctgttgcccaggctggagtgcagtggtgcaatctcggctcgctgcaacctccgcctcccgggttcaagaaattctcctgcctcagcctttcgagtagcagggactacaggctcgtgccgccattcccagctaattttttgtattttagtagagatggggtttcaccatgttgcccagggtggtctcaaactcctgagctcaggcaatccacccaccttggcctcccaaagtgccaggattacaggcatgagccaccgtg

SEQ ID NO: 293143 - DNA, 423 bp, Homo sapiens
ttctgtccccgctaggagacacagagtccccgtttctcacccatctgagggcccacgtctgaatccttaatccaggcctcttctcaagattcctagaattcgagagctattgagtatttgaatttccaagatgtgagtctcgcccggaagtttcccggaaaacggtcgctgacacagagtcctcggctaccacacaaaggccagagggctccaccgcccgcatcctgaccccctggtagccacaatgctgcaattgatgtgctgattcacgaaacaacacctattgagcacctgctgtgctgaacactgtcctaccttccaggggtggagcctgatccaaacagacaaaactcctgcccttttcgagtgtacgttttcacagagaaacagtaaaaataaatatataaacaatagattagtttg

SEQ ID NO: 293144 - DNA, 5300 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293145 - DNA, 5504 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293146 - DNA, 1000 bp, Homo sapiens
cacgcgtcgcggacggcgtgggtgacccacgcgtcggacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293147 - DNA, 657 bp, Homo sapiens
tcccgaagcttttaaaaacgaccggccccttaaattttaatacgacccccctttagggggaaattgggtacccggccccccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293148 - DNA, 865 bp, Homo sapiens
tccccagtttattgatatgattaacctggagatgccaaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaacatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgcgtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaa

SEQ ID NO: 293149 - DNA, 820 bp, Homo sapiens
tccccagtttattgatatgattaacctggagatgccaaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctctgtgcttctccttccttccttaacatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgcgtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaa

SEQ ID NO: 293150 - DNA, 856 bp, Homo sapiens
  misc_feature (761)..(761): n is a, c, g, or t
  misc_feature (801)..(801): n is a, c, g, or t
  misc_feature (841)..(841): n is a, c, g, or t
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaagcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaggccatcagacagatcttaaaatgaagcttggnaaaaagttggtgaactcttgtgcaaggcaaaagaacgcangggagaattcttggggaacttggcaaaatgcttagggcanaatgactggatcaag

SEQ ID NO: 293151 - DNA, 616 bp, Homo sapiens
gactgtctcttcaaactagaagataagcttttgagaatgggggttgtttagtcttcacattcagcaaattactgcagagtatataatgctcctgcttgtacctggtaagcactggttgaactggaaatgaaggttatgtgcgtgtgtgtgtgagtgtgtttgtgtgcatttgcacatgatggtgatggctaaacgtctgaggagatccatcaaggccaggatttggagtttgactgttgttttattaactagggtttgatgtcatctctaaagtctttgagcagttgctgcccttcttaaaggatgaaactttttcttaggctgcctgacccattttattgaaataaatgttcttaatatctgttttttcctcaaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggttgggttttgctcattcctcatacagtgttcagtaaagaaagttaattacagaacagtttctatacatttttgaatacttaccgtaaga

SEQ ID NO: 293152 - DNA, 667 bp, Homo sapiens
acggtcctctcaccgctctccagctcacaaccatttcctacctacagcttcatgatcttaaagtgtccattgagtctcatccctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttacctgtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatga

SEQ ID NO: 293153 - DNA, 355 bp, Homo sapiens
ttgaacctgggaggtggaggttgcagtgagccaagatcatctccatagactccaaactgaaccaggccaaaggttggctccgtgaccctagtgcctccccaggtaaccctctagttctgcttttctgatcaatacaacgagaagctaaaaaccaagcaaatgaaagaaagaaattttcccataatctcatcatctgagagaactactgtaacattatggggcataccccattatctgatagttctgagtaactgaagcaagtagtaggccttacaaggatgaagggaatagattcgatcacctctaatcacggaggagtaagtcatactgagctgggcattctttgcaaaatttt

SEQ ID NO: 293154 - DNA, 5123 bp, Homo sapiens
cgccacgatctttgcaatgctctgctttgagttggtcatggcttccagcttgcgagctgcattttccacttttgctgtgagcacatccagaccctgagatacctgctgagctttctgcatggccaccggtgaggatccttgtcctctggcacggaggtcagccacttgatcagtcatctgccctagcattttgcaagttcccagaatctcccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293155 - DNA, 4308 bp, Homo sapiens
tttactgggaaaaaggaaaaagccaagcatgttcatgaaaaccacatgtactgtgctattgggaatattttgtcattaagtatttgagggtgtacaatgacagcatgtgtctgttttgagcagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293156 - DNA, 3267 bp, Homo sapiens
gattcaggcctcagttgaaggacggcccgagaactcacaccccaggtggtctcgggctgcttcggtattcttttaaccttttaaggggggaaaaaaccccccaccctttggcgcaaaaattcaacaggctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293157 - DNA, 3215 bp, Homo sapiens
attatgtaggaagagtttgagctgaagaagagaattctggatgttatactttctcatgagaagtttgagtggataacagtgttttggagtttctgttcttctaaattgaaactaaattccatttctgttttcctaacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293158 - DNA, 5250 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaataagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293159 - DNA, 5249 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293160 - DNA, 2847 bp, Homo sapiens
tccccagtttattgatatgattaacctggagatgccaaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaacatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293161 - DNA, 2300 bp, Homo sapiens
tctgaggttcccgtggctagcggatcagggcaccgtcttaaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293162 - DNA, 2189 bp, Homo sapiens
gggtctgtcgccacctttgggggagaaacaacctcagccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293163 - DNA, 2123 bp, Homo sapiens
cggatgtgatttttcagctcccagccactctgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293164 - DNA, 4322 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293165 - DNA, 1826 bp, Homo sapiens
aagtcatttcgagggcaatcggtcattcctattaacctatctcactttctaatttctaccacattgccattccacttctcaatatttaaccttggagtggacccatcgcgtgaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293166 - DNA, 1391 bp, Homo sapiens
ccacggggccgacccacgcgttcgataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttaaaatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293167 - DNA, 5041 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaatgctttaaatgat

SEQ ID NO: 293168 - DNA, 4345 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccagcagtagccacagggatcctgctagagtccgacc

SEQ ID NO: 293169 - DNA, 4571 bp, Homo sapiens
  misc_feature (4440)..(4440): n is a, c, g, or t
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtatgtgagcgaatcccaaccataagcacccagctcaaaatcctgtccacagtgaaggccaccatgctgggccggaccaacatcagtgatgaggagtctgagcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtatcttttcagatacacatcattgatatttttatctgtgaattctgtttacttcctttccccatattttttcctagtttattgtcttttgacttggttaatgatgttttttatttttctgtttttttctccaagcaaaagtattttanttttatgtagttgaatttagtaatcttttctgtggcttctggatttggattataggtttccccatttcaagattatggctggacatggcctgtgggtggctctcccctggcaggaggaagatcatggtctc

SEQ ID NO: 293170 - DNA, 3318 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgcgtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaa

SEQ ID NO: 293171 - DNA, 3196 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggtggtctcggctgctcgtatcttacttaggaaccctggaaatcaagctgcttatgaacattttgagaccatgaagaaccagtggatcgataatgttgaaaaaatgacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggactgcaaaagagcttcctggactcaggatatcggatcctgggagctgtggccaaggtcagagaagccttccaacctcaggagcctgacttcccgccgcctccaccagaccttgaacaactccgactaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttacctgtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatga

SEQ ID NO: 293172 - DNA, 2295 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggatctaaaagctcggatgcaggaggccatgactcaggaagtgtcagatgttttcagcgataccacaactcccatcaagctgttggcagtggcagccacggcgcctcctgatgcgcctaacagggaagaggtgggtatctgaggtcttccatttttctgtcagcctgtgctataggtatatgtaaaggtgaaatgtgattacagtggacatcaggatcagtggttgggaaactgtagatgaagggtggaagagcagaacagggaaagccctaccacctctacttttagtctccacgtatatcagtgaggaatatctttagttgcaagcaatagaagacctgaccatcagagatgaaaacaaccgggtttgttttcatcacaaaccaagaaacatggaagtaggtggctttggcattggttcagcagctaaatatcatgaaagctggcatttctatgattt

SEQ ID NO: 293173 - DNA, 1893 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacaggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtaagggcagcagtgcactataacctcattaaattggtctcagtgcaaataagcaagttgttgataggggtcctgtaacatctgtaattaggtaagggttctttagctgctgataagtaactgtgattccatttccaaatgcagccagtaaaattcctgtgatgtaatcaagaagcagaccaggcatggtggctcacagtgctcaaggaggctcacagtgctcaaggaggctcacagtgctaaggaggctacagtgc

SEQ ID NO: 293174 - DNA, 1349 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtccgtaaaattattagagtttgcaaaggaattttggaatatcttacagtggcagaggtggtggagactatggaagatttggtcacttacacaaagaatcttgggccaggaatgactaagatggccaagatgattgacgagagacagcaggagctcactcaccaggagcaccgagtgatgttggtgaactcgatgaacaccgtgaaagagttgctgccagttctcatttcagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggacactgaagccatgaagagagcattggcctccatagactccaaactgaaccaggccaaaggttggctccgtgaccctagtgcctccccaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccaggtaaaagttcctctgtccttacagagcagtagtgggtaactcactcctaacagggtgattcagaaaacaagcctctgccagtttggagttatctcttgggctagtagataacagagatattatagtctattaaattcttttgagatggaggtgaactttcccttggctgactttatttatttatttattattttttggagacagagtctcactctgttacccagacaagaacca

SEQ ID NO: 293175 - DNA, 567 bp, Homo sapiens
tagtcgctgcacagtctgtctcttcgccggttcccggccccgtggatcctacttctctgtcgcccgcggttcgccgccccgctcgccgccgcgatgccagtgtttcatacgcgcacgatcgagagcatcctggagccggtggcacagcagatctcccacctggtgataatgcacgaggagggcgaggtggacggcaaagccattcctgacctcaccgcgcccgtggccgccgtgcaggcggccgtcagcaacctcgtccgggttggaaaagagactgttcaaaccactgaggatcagattttgaagagagatatgccaccagcatttattaaacttttactagaggaaatcctaaagaatgtacttcagacaagtccgctgatcccagatgtaagcctgaaatacaagagggaatgatgagccaagatactggacagtttgttggtaaatgtagataagtgttgatgtatataataatgggatgtttttactcaacgcttctgataccagatgtatggctttttttttccacaccaacaacctggtcgaccgtctcacctgacacca

SEQ ID NO: 293176 - DNA, 288 bp, Homo sapiens
gatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccaatggtgatggatgcaaaagctgtggctggaaacatttccgaccctggtaagcaatgcatggcactatgtctcacctccactgagaggttaactcaggaaaggtcgtgagggaatatgtaccccacaaccaccacatacaa

SEQ ID NO: 293177 - DNA, 673 bp, Homo sapiens
acacacgtgtgcgcgcacacgcacaactaaaaacgtgattctgatttgttggaaattcttccaacaggaagaatcactgtaagttgttactactaaattaacttggttttatttattttcttttctagccaatactgatgcaagaaaatatttcaattctcaacctgattaatgtactgcagagtctgttccactggggaaaaaatgcagagaggcattgcttcaaagccttgatccagattaaagtgatagagaccttaaaaaaaaaaaaaactgaaaacatgtattggtgatcactgtttcccttaaaatatacttcaagaaatgcaaaggaaaccatagaatttaaaaggaaaataaaaagtgctctcaggggatctgagaaaacagcaccaaatatattatttaaaaaattaaatattatttacaaaagtatattttacaagcaactgtttcttttatatatatccacttgaaaatctctttataaagggtcatctctttcgcacacactgatccaccagtaaaaatgcactctagcctatcctcgtgaactcaggaagaacactcagtcaggttcagctgacagcttgtgggtatcgagtttggctgtgtttggttcatgtcaaatcaatccatcagcagcctgagactaatgtcccgggtcccgagg

SEQ ID NO: 293178 - DNA, 616 bp, Homo sapiens
aaacaggtcactggaagaagataatatactgaaggacaaataaaagtcaagtgtagctgggcccagaatggccaatactgatgcaagaaaatatttcaattctcaacctgattaatgtactgcagagtctgttccactggggaaaaaatgcagagaggcattgcttcaaagccttgatccagattaaagtgatagagaccttaaaaaaaaaaaaaactgaaaacatgtattggtgatcactgtttcccttaaaatatacttcaagaaatgcaaaggaaaccatagaatttaaaaggaaaataaaaagtgctctcaggggatctgagaaaacagcaccaaatatattatttaaaaaattaaatattatttacaaaagtatattttacaagcaactgtttcttttatatatatccacttgaaaatctctttataaagggtcatctctttcgcacacactgatccaccagtaaaaatgcactctagcctatcctcgtgaactcaggaagaacactcagtcaggttcagctgacagcttgtgggtatcgagtttggctgtgtttggttcatgtcaaatcaatccatcagcagcctgagactaatgtcccgggtcccgagg

SEQ ID NO: 293179 - DNA, 706 bp, Homo sapiens
agtgcagtggcgcaatagctcactacagccttgaactcacgggctcaagcagtcttcctgcctcagcctcctgagtcctgggaccacaggcgcacgccaccatgccctgctaatatttttaagtttttgtagagatggcgtcttatcagccgtaatcaagccccctctccagggccatggcacacaggctggtcccggcagacaggctggctgcttcacctccccactgccgttgccacacaactcactcctgggacagtgcacctcctccacaccgagacatggagtccctgtcccaaagccacacctggctgccaggtgtcccaagccacctctctggacttggaaggaaatggggacactgtctcaggttggaacctgtaaggggctgacttgtgtccccactaattcacaggttgaagcctgaaccctcaggacctcagaatgtgactgtgtttggagatagcatctttaaggagggagttgaggtcactggggtgggccctaatccagtctgactggtgtctttatacaaggagatgattaggacagagacgtgcatagagagatgatgccatgaggacgcggggaggagacggcatcttcaggcctaggagagaggctcaggaggaaccaggcctgcccgcaccttggcctcagccacccagcctccaggactagcagactgggagctaacagccctttc

SEQ ID NO: 293180 - DNA, 460 bp, Homo sapiens
tccaggaccagctctccaggaggcccacattctttctgcgggaaccactccaaaggggcatgctgttccaggcagcccctcgcgcagacactccggctttgtcgagggcccacaacgcgtccccggtgatgttcatgcccacctcccagtagtgcctcccagaggagaaggccgtctggcccacagcacagggagcccccagtgcctcacctaagctgagctaccctgtcagcccacggccacacgcctgaggtcctgcaactcaggagaggcggagggaccccttccaggagatgattaggacagagacgtgcatagagagatgatgccatgaggacgcggggaggagacggcatcttcaggcctaggagagaggctcaggaggaaccaggcctgcccgcaccttggcctcagccacccagcctccaggactagcagactgggagctaacagccctttc

SEQ ID NO: 293181 - DNA, 821 bp, Homo sapiens
cccctcggctccttctcggtcacgcgcctgccccaacctctggctggcttcggagcctgcaggcactgaagggagtgcaggttcgctcctccgcggaagttcttccccggatgcacaggcgggagcccggtgtcggtgtacgaggatcccccggacgccgagcccacagcgctgccagccctcaccaccatagacctgcaggacctcgctgactgctcttcgctactcgggtccgacgcgccgcctggtggtgacctggccgcctcgcagaaccattcccaccaaacggaagcagacttcaatctgcaagatttcagagacacggtggatgatctcatttcagactcatcctctatgatgtcgcctaccctggccagcggagacttccccttctctccttgcgacatatcaccattcgggccctgcctctccccgccactggacccacgggccctgcagtcaccaccgctgcgccctccagacgtgcccccgcctgagcaatactggaaggaggtggcggaccagaaccagagagcgttgggagacgcgcttgttgagaataatcaactgcacgtgacattgacccagaaacaggaggagatcgcctcgctcaaggagcggaacgtgcagctgaaggaactcgccagccgaacccggcacctggcctcggtgctggataagctgatgatcacacagtcccgggattgtggggcggcggccgagcccttcctgctcaaggcgaaggccaaaaggagcctggaggagttggtcagcgctgcggggcaggattgcgcggaagtggacgccatcctgagggagat

SEQ ID NO: 293182 - DNA, 1008 bp, Homo sapiens
cccctcggctccttctcggtcacgcgcctgccccaacctctggctggcttcggagcctgcaggcactgaagggagtgcagggtgtggatcgctgccccagcccgggccgccgcctccgagcagtcggcacccggaggcaggaggcacaatgcaggcgtgcgggggcggcgcggccggccgtcgggccttcgacagcatctgccccaacagaatgctggcactgccgggccgggcgctgctctgcaagccggggaagccggagaggaagttcgctcctccgcggaagttcttccccggatgcacaggcgggagcccggtgtcggtgtacgaggatcccccggacgccgagcccacagcgctgccagccctcaccaccatagacctgcaggacctcgctgactgctcttcgctactcgggtccgacgcgccgcctggtggtgacctggccgcctcgcagaaccattcccaccaaacggaagcagacttcaatctgcaagatttcagagacacggtggatgatctcatttcagactcatcctctatgatgtcgcctaccctggccagcggagacttccccttctctccttgcgacatatcaccattcgggccctgcctctccccgccactggacccacgggccctgcagtcaccaccgctgcgccctccagacgtgcccccgcctgagcaatactggaaggaggtggcggaccagaaccagagagcgttgggagacgcgcttgttgagaataatcaactgcacgtgacattgacccagaaacaggaggagatcgcctcgctcaaggagcggaacgtgcagctgaaggaactcgccagccgaacccggcacctggcctcggtgctggataagctgatgatcacacagtcccgggattgtggggcggcggccgagcccttcctgctcaaggcgaaggccaaaaggagcctggaggagttggtcagcgctgcggggcaggattgcgcggaagtggacgccatcctgagggagat

SEQ ID NO: 293183 - DNA, 784 bp, Homo sapiens
cccctcggctccttctcggtcacgcgcctgccccaacctctggctggcttcggagcctgcaggcactgaagggagtgcagggtgtggatcgctgccccagcccgggccgccgcctccgagcagtcggcacccggaggcaggaggcacaatgcaggcgtgcgggggcggcgcggccggccgtcgggccttcgacagcatctgccccaacagaatgctggcactgccgggccgggcgctgctctgcaagccggggaagccggagaggaagttcgctcctccgcggaagttcttccccggatgcacaggcgggagcccggtgtcggtgtacgaggatcccccggacgccgagcccacagcgctgccagccctcaccaccatagacctgcaggacctcgctgactgctcttcgctactcgggtccgacgcgccgcctggtggtgacctggccgcctcgcagaaccattcccaccaaacggaagcagacttcaatctgcaagatttcagagacacggtggatgatctcatttcaggcaagtgcagtctcctggcagttaaataacagcgggggtgtcccccactcccaaatcagactagttcagatttcgtggtcgtgaaggtggtgaacccagccaactgtcaacgactctccagcaactcatcaaagagtcagccttttccatatttaggacatttctctcccccgtggagaagtcgaaccgctggatctacatagcgctttatctgggatcggtgtgagttctgggagagggagccctatgctgtg

SEQ ID NO: 293184 - DNA, 2214 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293185 - DNA, 956 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagagcctttgcactggcgatgccatctgctgcctggatgtcttcctgctggctggtcccgttgcatggtagccttaggtgtctcctcagagaggtccctcgctgaccatcaggctcctcactccctgtcgtatccccttcaccaaagattcccattccctgacgacgcctgtcccctcggaatgcaggcctcgtgggaattcagcccatccgcaagtgcagtggcagggcggcccccttcccccttgacgacgcctgtccccttggaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcgtaatgcaggcctcgtgggaattcagcccatctgcaagtgcagtggcagggcggcccccttctcccttgaggacgcctgtcccctcggaatgcaggcctcgtgggaattcagccccatctgcaagtgcagtggca

SEQ ID NO: 293186 - DNA, 556 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccaggtgagctgtgggctctgccctcccagcccgcctgcacccccttgccctggccaccctctccctcacccagcccctctgagtcc

SEQ ID NO: 293187 - DNA, 503 bp, Homo sapiens
aggctggtacggtcggaagtcttagatgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccaggtgagctgtgggctctgccctcccagcccgcctgcacccccttgccctggccaccctctccctcacccagcccctctgagtcc

SEQ ID NO: 293188 - DNA, 2401 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggtaggtgggccgcggaggggcgaggggccgggccgggccggggtcccgggggggtggggtccggggcgggggctccgaggcggtgtgggtgggaggtggagcggtgggccgggggcgttcgccctgaggtcgggccgagcgtccccagctcccctggagaaccctgaggaccggccactgcgcccaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293189 - DNA, 2230 bp, Homo sapiens
gcggcagtgcatgcccgacagccccgcaggtcccctgaggcacgcagtgtgccgatgcggtcccgctgactgcgcccctgctgcaatgtcggcatagctgtgtgctgcgtccatgtgcgctctgcgtccgtgtgcctgccaccctcctggtgtgcccctgtgcctgatgtgcccctgcgaccattggtgcatggttgcgacgctggcaccgcgctgcatgtgtgccccgtgctgtgcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293190 - DNA, 2233 bp, Homo sapiens
ctcgcccacccagggccggggattggtgctgggccttctcctggcagcgcgggccccagccccctgcccggtatggatggacgctgggccctgctggatccagaatccatcgtgaggtgagatgggattacgacaccaagcccatgccatggggtgtgctgaggccagcagtgctgaggggcggcgtggcggcaccctgtccaggctcagctccggcctattggctctgcggttcctggctgaaaaccaccctgtagcctcctgaagctcacctccccaacggggcaggaacaggctgggctgccaccacgcacatgtgcctaccgtcagaatgtcacagtcactggacacaggtgcaggcaagcctgagtccagctgctccgtgtccacctccctggctccccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293191 - DNA, 1943 bp, Homo sapiens
ctcgcccacccagggccggggattggtgctgggccttctcctggcagcgcgggccccagccccctgcccggtatggatggacgctgggccctgctggatccagaatccatcgtgagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293192 - DNA, 1670 bp, Homo sapiens
agattcacctgtgctggggggacagcaaggctcctctgtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293193 - DNA, 2089 bp, Homo sapiens
cctgtgtaggatctgtttattcacagaccgcgccgggcagtcctgggcttgaacgtgtgtgtcagccgcgctgccagccatgctgaggctcgggactgagccgcccctttgttgtccccagccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293194 - DNA, 1395 bp, Homo sapiens
ttcgattcgagctcgtacccgaacggtgatgcggttggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293195 - DNA, 950 bp, Homo sapiens
cggcacgaggagttctctcaggacggtaaggcgtacaccccggtcagcaggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293196 - DNA, 988 bp, Homo sapiens
aggctggtacggtcggaagtcttagatgcgtggccatgcgtcccctgcgcccccgcgccgcgctgctggcgctcctggcctcgctcctgaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcctgtggacatacgagatccagttctctcaggacggtaaggcgtacaccccggtcagcaggaagccatcgaccttcaacctctttgtgttcagcccagacacaggtgctgtctctggctcctaccgagttcgagccctggactactgggcccgaccaggccccttctcggaccctgtgccgtacctggaggtccctgtgccaagagggcccccatccccgggcaatccatgagcctgtgctgagccccagtgggttgcacctccaccggcagtcagcgagctggggctgcactgtgcccatgctgccctcccatcaccccctttgcaatatatttttatattttattattttcttttatatcttggtaccaacgccccctttaaagcggctttgca

SEQ ID NO: 293197 - DNA, 1914 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtaggtacggactggcgcatgtttccaagtggaacttcgagacgtggaatgagccagaccaccacgactttgacaacgtctccatgaccatgcaaggcttcctgaactactacgatgcctgctcggagggtctgcgcgccgccagccccgccctgcggctgggaggccccggcgactccttccacaccccaccgcgatccccgctgagctggggcctcctgcgccactgccacgacggtaccaacttcttcactggggaggcgggcgtgcggctggactacatctccctccacaggaagggtgcgcgcagctccatctccatcctggagcaggagaaggtcgtcgcgcagcagatccggcagctcttccccaagttcgcggacacccccatttacaacgacgaggcggacccgctggtgggctggtccctgccacagccgtggagggcggacgtgacctacgcggccatggtggtgaaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctggatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggcctggtctacgtcacgcgctacctggacaacgggctctgcagccccgacggcgagtggcggcgcctgggccggcccgtcttccccacggcagagcagttccggcgcatgcgcgcggctgaggacccggtggccgcggcgccccgccccttacccgccggcggccgcctgaccctgcgccccgcgctgcggctgccgtcgcttttgctggtgcacgtgtgtgcgcgccccgagaagccgcccgggcaggtcacgcggctccgcgccctgcccctgacccaagggcagctggttctggtctggtcggatgaacacgtgggctccaagtgcgtgagtggggccgcccctccctctgcctggtcctaggcaggtccctgggtcccgaccccttcacccatgcggtcactcgggccacttgccgtggc

SEQ ID NO: 293198 - DNA, 771 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagggggtccactggacggggcctgagctacaacttcacccacctggacgggtacctggaccttctcagggagaaccagctcctcccagggtttgagctgatgggcagcgcctcgggccacttcactgactttgaggacaagcagcaggtgtttgagtggaaggacttggtctccagcctggccaggagatacatcggtgggcgagcgcaggccctggggccctggccggggcgggggtactcctgggcaggttgcacccctatcacgcaggctgctgcctggtcaggagatacattggtgggcaggcgcaggcccttgtggggggatgggggtgacaagggataggttggtggtcggcgcaggccctggggccccaggctgggggg

SEQ ID NO: 293199 - DNA, 780 bp, Homo sapiens
gtcacatggggtgcgcgcccagactccgacccggaggcggaaccggcagtgcagcccgaagccccgcagtccccgagcacgcgtggccatgcgtcccctgcgcccccgcgccgcgctgctggcgctcctggcctcgctcctggccgcgcccccggtggccccggccgaggccccgcacctggtgcaggtggacgcggcccgcgcgctgtggcccctgcggcgcttctggaggagcacaggcttctgccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccagccatgcaccctgcgtccagccccgtgaggctgtagagtgactgcaggaagaagtccttgttggcatagtacagcggccccccaaagcggaacacccgcacgccgggctcagggacgaggccctcgaactctgtggcatcctcgtagaaggccgtgtccccgatgcgggccagcagggcggtgcgtgggcgttgggtgcggccggccaggctgagcagcgagaggatgacgccagccagcagcccggcctctgtgctgaccagcatacaggtggccgcggtgcctgcccagaccagcgcgtcagccgggctcatccgccacagccgcgggaggtcccacaccttgcgcagggccccccgcaggctgaccacgatgacgcaggccagcacgcttc

SEQ ID NO: 293200 - DNA, 464 bp, Homo sapiens
attcctggccctaagggtcattttattagtcactgaacgcacgggcagcgcctggatcctgcgcccgggcagtcctgggcttgaacgtgtgtgtcagccgcgctgccagccatgctgaggctcgggactgagccgcccctttgttgtccccagccccccgctgccacacagccaggctgaccagtacgtcctcagctgggaccagcagctcaacctcgcctatgtgggcgccgtccctcaccgcggcatcaagcaggtccggacccactggctgctggagcttgtcaccaccaggtgggcggcgggcagggtctgggcgtcccagagccccttacagaggcacagatgggaggggagggctgggggctgctcggaagaccccttgttcccccacctcccgccgaagcaccctgttggggagagcgtgtccttgctggctgtgctggggtgagggctgtgtgctg

SEQ ID NO: 293201 - DNA, 995 bp, Homo sapiens
gggaggcgtgagccaccgcgcctgtccaggaatcagttttttccaacaagtttttggactccactttgagaaatcctgacctgcactatgcctgaaacactccaaagggggtgctgatctggagacagatctgtcctgggacctgtttcagccctgtcagctcctggtggctgagttgaagggtgtggcccaaaaggcagggcaaagctagcttctgggttccttcagcccctgcaaggtttgggactctgtccacaggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293202 - DNA, 1345 bp, Homo sapiens
gggaggcgtgagccaccgcgcctgtccaggaatcagttttttccaacaagtttttggactccactttgagaaatcctgacctgcactatgcctgaaacactccaaagggggtgctgatctggagacagatctgtcctgggacctgtttcagccctgtcagctcctggtggctgagttgaagggtgtggcccaaaaggcagggcaaagctagcttctgggttccttcagcccctgcaaggtttgggactctgtccacaggtccagacccagtacttattatgaactgttgggggtgcatcctggtgccagcactgaggaagttaaacgagctttcttctccaagtccaaagaggtacccgtacccctgaggtggggagggggagcaggaactttgagccagtgggggtgtgcttcaaattcccaggagtagaccagcatctctggtgggtgccacattttttcagccctcatagggagtggcaggtgctcaatggtaggggaaaggctgtgggcaggagccaggggtcctgtctgatgggctgggcttggttttcttgacctgcctgcctgctcttgagaaacctggaccagggcatatggtgaatgcagggggctggcaggtggggagggcttgaacacaggaggaagcaggagtccatgctctctggccttctgaggagtgggcaggcctgagtgagggtcactgaccaggcagggcctctgggtatgactggagccctggtgggtggatgtcatcagcatgggtcctggggagggacaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaaga

SEQ ID NO: 293203 - DNA, 766 bp, Homo sapiens
agagatggggtttcaccatattggccaggctggtctcaaactcctgacctcaggtgatccacccgcctcagcctcccaaagtactgggattacaggtgagagctaccgcgcctggccacaaagccgattttctatagcagatacctaaaggccagtgcccactgctagcagcctgcctagttcagtgatggagttagacgcataccctttctagtcttctgggaggagcacccccatgtccacagctgctgtcacacctcaaagtgaccagggacttcggatgccattggaccctagacaagccagggccactctgagccctccctatctatcacaggaagggttagactgaggttcctaaccctgtgtaagggtaaaaagctgtgaggcccctagagtggggtggaagggggcaggacttcagggacagcaggaattggattcccagggttaattgtgacccattgcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293204 - DNA, 552 bp, Homo sapiens
gcggggggccggcccggttgttcaatgggtttctgtttgccctacgtgctgagttagttgtggtctctactccgtgtcaggaggctcccaggtttgtctcaggtaaccctcgccttccctgctgaggatcagagatagagaagacccccaaggtcatacaccgatttaagcggcagaggaggaagtttgagtccaggtcaaacccaacgctcttaccacagctctagtggtttccaagcatcgctgtatcactgtgcataaccctctgtggggggtgggagatggggaggtgtcgggtacaaaatccagattcctgggctctgctctggagattctgaacttttttttgagatggagtttcgctcgttgcccaggctggagtgcaatggagcaatctcggctcaccacaacctccgcctcccgggttcaagcgattctcctgcctcagcctcccgagtagctgggattacgggcatgcaccaccacgcccggctaattttgtatttttaggagagacagggtttctccatgttagtcaggctggtcttgaac

SEQ ID NO: 293205 - DNA, 316 bp, Homo sapiens
gcagtaagggcggcatggcggcgggcgggcagctgggaaaggaggctaccaagagcgcattggaccaggatggggctagacttcaagcacccgggggcagagggaagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293206 - DNA, 1376 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293207 - DNA, 1487 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtgggcgcccgcgcctgtccagcgagtccgcaggctgggggaccggaggcaccaaaggccaatagacatgtaggggcggggtctccaccgattttttttttttcctgacaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293208 - DNA, 1124 bp, Homo sapiens
  misc_feature (32)..(32): n is a, c, g, or t
  misc_feature (67)..(67): n is a, c, g, or t
  misc_feature (74)..(74): n is a, c, g, or t
  misc_feature (109)..(109): n is a, c, g, or t
  misc_feature (118)..(118): n is a, c, g, or t
  misc_feature (204)..(204): n is a, c, g, or t
ttttctccgaatcactttattgcgcgcgtttnggggagcgggccgtccagggaaggaagcaaagcgngaacganctgcaggccccatccaggtgagcccctcagggcgngacgcccgnggcacgatctcggggccttgggttggctcggatggtggcggctgcgctgccctagccgttgtcgctcctgctgaaggatgcctctnttgccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293209 - DNA, 1468 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293210 - DNA, 1841 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagaggtacccgtacccctgaggtggggagggggagcaggaactttgagccagtgggggtgtgcttcaaattcccaggagtagaccagcatctctggtgggtgccacattttttcagccctcatagggagtggcaggtgctcaatggtaggggaaaggctgtgggcaggagccaggggtcctgtctgatgggctgggcttggttttcttgacctgcctgcctgctcttgagaaacctggaccagggcatatggtgaatgcagggggctggcaggtggggagggcttgaacacaggaggaagcaggagtccatgctctctggccttctgaggagtgggcaggcctgagtgagggtcactgaccaggcagggcctctgggtatgactggagccctggtgggtggatgtcatcagcatgggtcctggggagggacaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293211 - DNA, 1296 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293212 - DNA, 933 bp, Homo sapiens
gcggggggccggcccggttgttcaatgggtttctgtttgccctacgtgctgagttagttgtggtctctactccgtgtcaggaggctcccaggtttgtctcaggtaaccctcgccttccctgctgaggatcagagatagagaagacccccaaggtcatacaccgatttaagcggcagaggaggaagtttgagtccaggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293213 - DNA, 1317 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccaggcccaacacggtgcgttggcccaacacggtgcgttggcccaacacggtgcgttggcccaacacggtgcgttggcccaacacggtgcgttggcccaacacggtgcgttgagccaacacggtgcgttgagccaacatggtgcgtatgaccaa

SEQ ID NO: 293214 - DNA, 1261 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaaga

SEQ ID NO: 293215 - DNA, 1281 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaagaaaaaaaaaaaaaagtcgacg

SEQ ID NO: 293216 - DNA, 1322 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293217 - DNA, 1282 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293218 - DNA, 1179 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagctgcacccagaccgggaccctgggaacccaagcctgcacagcacaggggccccagttgaggcagcagcaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293219 - DNA, 1121 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293220 - DNA, 1193 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagcaggcaaagggagataaggggagtcctgccccaccccagctgcacccagaccgggaccctgggaacccaagcctgcacagccaacacaaacaaaacaaacaagtgctggggtactgcctcctcctcatgctggcgggcatgggcctgcactacattgccttcaggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293221 - DNA, 935 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggaaggtgaagcagatgcaccttaacttcatggatgaaaaggatcggatcatcacagccttctacaacgaagcccgggcacgggccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcaga

SEQ ID NO: 293222 - DNA, 1300 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagcaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaaga

SEQ ID NO: 293223 - DNA, 1320 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtccagacccagtacttattatgaactgttgggggtgcatcctggtgccagcactgaggaagttaaacgagctttcttctccaagtccaaagagcaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaagaaaaaaaaaaaaaagtcgacg

SEQ ID NO: 293224 - DNA, 648 bp, Homo sapiens
ccggggcggaagcagctccgtaagatatacctcgctgcagaggggagcaacagcggaacggagacacggtggccgggccgaaaacgtcacaaagccgcagagagcgggctctgtcccgcccgctccccaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctccccgctccccgaaacgcgcgcaataaagtgattcgcaga

SEQ ID NO: 293225 - DNA, 1431 bp, Homo sapiens
  misc_feature (820)..(820): n is a, c, g, or t
ccggggcggaagcagctccgtaagatatacctcgctgcagaggggagcaacagcggaacggagacacggtggccgggccgaaaacgtcacaaagccgcagagagcgggctctgtcccgcccgctccccaggtgggcgcccgcgcctgtccagcgagtccgcaggctgggggaccggaggcaccaaaggccaatagacatgtaggggcggggtctccaccgattttttttttttcctgacaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctcgacgaccatagccaggagcgagacatgccaggactgagacaacggagcctaatgcgccgatacccacaggcccccaagagatcaaaatatatactcgcagagccaaatgctaataacacggctaaatgatcgcaccaagactcgcaacaaggccaccgcttgcatcataccaggcgcgagacaatctgcgcatcttccattatgccatgtataagtgcccttcattgtgctgccctacgccggtcaccagttaggctggtctaccggattatgggatgccaaatcctggaacnatatagatatgaggtaatattaatgatatcaggccttatgggagccgaacactgggaatagagtatgaagcctgagcgaagacatctgcaaagcgcattggacggcaggggagcgctggagccaagaatgcctggtaaaccgcatgtcggcggcacaagccagcttgagataatcgttatgcaggggcaaatcagagaaatggcattcccatatatcaaaatggcaccattaacgaatgaagatatcctgtccatttttgcaaattgaatattccctgaattggatcttccacatgaccgattaattcaggggactgaaaacaagtgcccatttcaattcacacttttcacccattttgctcgcgcttgcgtaaacatctttcgatagactaaaagaccgctatttggactgcgtttcaaagttgtttccactttgagtggcgcccctattaaatatatttcaaacaaggcatttactaaagctggtagattggttgggtttattgggaaaaacggatctggtgacggatcataactggttctgagcgagaggccggtttccaacattatccgacttggaaaggagatggcctaattccttctaattggag

SEQ ID NO: 293226 - DNA, 394 bp, Homo sapiens
gggttctgaaccaggagacagaagagaaatgaatggatgtctgcatcgcttcagagaaaggactgtgatagaagaatacaaatcagtggaagcagccaatgaagttgaggatcagtgtggattccatgcctgtttatttgccccagtcaaaatacagttttgatttcatttccccctaaaatggaattaaaacgtcacaagcaagtgagcatcaaagtatctccagtcctcgcagccagagccctatgctgaaaactcacctccagctgtccttcttcagtgcaggcatgcagtttaaagtgcgtgatgctgatggctgtgataacgtgccccttcctcctggagtcacaggcacagtggggaaagatgatttcattgtagccctcacaagtcc

SEQ ID NO: 293227 - DNA, 399 bp, Homo sapiens
gcgtggcctgccaccatcttgggagctctaagaacaaagacccgcccataacaccctctctactaaaagtaaaaaattagccagccctggtggcaggaacctgtaatccagctactggggaggctgaggcaggagaattgcttgaacccgggaggcggaagttgcagtgagctgagatcacgccactgcactccagcctgggtgacagaacacaactctatctaaaaaacaaaaaccctgaggcaaaattaatagacaaagtctcactctgctgctcaggctggagtgcaacagcgtgatcgtagctcaagtccaccaggattataggcatgagccattgcacctggcctgcccttggaattctgatgaataaagtgctcgtcaataaaacttttcttt

SEQ ID NO: 293228 - DNA, 1743 bp, Homo sapiens
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgaggtgagactagagttgtcacagcccaccgtggccactaacgtgtctttgtttcacagactgtgtgatcaagtaaatgtgctgtagatctttgcctcattcacagcggaggtgagagttagaatttatacctattgttcatgccacgtttctcctcatggatgcacgcatcccctattatttgtttcttttaataatgtcacgagcaccaatgagcttactacccaacttcaaaactaggactctaacaataacttctgtcatatctcatcctgtaacgcccccaccttcgctccttccgccaagataattatcactttaaattgtgtgcgtgtgtattctcatttcttatgtgatggtaaaaatgcctttattttgtttggttttaatgcatagaaaggacatcaagctgtatgtaataattcagtaattatgtttatataatattaaattgctaatatttgcccatattg

SEQ ID NO: 293229 - DNA, 755 bp, Homo sapiens
tggatggatcaatgccattatggggaacatagtttgacagtcactgagtatgccctgagggataagggatacatttgctttgacaaaagtaaaaacctcgtaatggttgtgttattttgttttgtttttaaagattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgaggtgagactagagttgtcacagcccaccgtggccactaacgtgtctttgtttcacagactgtgtgatcaagtaaatgtgctgtagatctttgcctcattcacagcggaggtgagagttagaatttatacctattgttcatgccacgtttctcctcatggatgcacgcatcccctattatttgtttcttttaataatgtcacgagcaccaatgagcttactacccaacttcaaaactaggactctaacaataacttctgtcatatctcatcctgtaacgcccccaccttcgctccttccgccaagataattatcactttaaattgtgtgcgtgtgtattctcatttcttatgtgatggtaaaaatgcctttattttgtttggttttaatgcatagaaaggacatcaagctgtatgtaataattcagtaattatgtttatataatattaaattgctaatatttgcccatattg

SEQ ID NO: 293230 - DNA, 848 bp, Homo sapiens
ctgggacactgacacccataccactggcatcttagttccgattgctgacgaagtgccttgtacctggggcgttgtcctggttctggttttttcttctgccactggcattcagcgtgctatactctcactcctttgatagaggtccacctcaggttagtttatctcatgtatctcttgtattcccttcgatggggtcagggatgaagagataagatcttcctccagggacattgatcgttcatggtcctttgaccaatcctggcccaacttggtgacgggcatccactccgttatcctcggccttgcctccgcgagctcctgcggccttcggccccggccccgtccatcgtgcctggtcctgatccccggtcctcggattgccatcttgccttaactctcctgcggaagccactcgcggttccccatcccagggccatccagggcccccgggccccctccgctgcaccggtgcgtcatccggtccatttgctgggatatagctgacaagaaggaactagtcagtgtggcctactgcatctggcagcctcccgcgagacccagacaagggctcccgcccaggagcgcggactcgggagcactagacccgacccgatgtccgcggattcccgccgcccacgcagaggcccgctgcatgcgaccaacaggactcacgtgttttgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaaattgtgt

SEQ ID NO: 293231 - DNA, 242 bp, Homo sapiens
gaggaaggttttatccaagaagagagtaagagaaaagtctggaaagagatttagtaagatagaaatgacattgaataatatgaaacaacgtataaaaaaggaaaagaacaaaggaggctggggtgagagtatgtaatttatttcacaattttgttttccaagtggctatatgaggaaactaatcaccatttaaaatagaccacaaaattttttcaacagcaatagctaatatttatatctct

SEQ ID NO: 293232 - DNA, 5688 bp, Homo sapiens
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcgtgagtacccccgacccgcccgtccccgctctgctcgcgccctgccgctgcgccgccctcggtggcttttccgacgggcgagccccgtgctgtgcgggaaagaatccgacaacttcgcagcccatcccggctggacgcgaccgggagtgcagcagcccgttcccctcctcggtgccgcctctgcccagcgtttgcttggctgggctaccacctgcgctcggacggcgctcggagggtcctcgcccccggcctgcctacctgaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaaggagaaccctcacctaataataatgaatgtcagtgactgtatcccagatgctattgaagttgtaagcaagccagaagggacaaagatacagttcctaggcactaggaagtcactcacagaaaccgagttgactaagcctaactacctttatctccttccaacagaaaagaatcactctggccctggcccctgcatctgttttgagaacttgacctataaccaggcagcttctgactctggctcttgtggccatgttccagtatccccaaaagccccaagtatgctgggactaatgacctcacctgaaaatgtactaaaggcactagaaaaaaactacatgaactccctgggagaaatcccagctggagaaacaagtttgaattatgtgtcccagttggcttcacccatgtttggagacaaggacagtctcccaacaaacccagtagaggcaccacactgttcagagtataaaatgcaaatggcagtctccctgcgtcttgccttgcctcccccgaccgagaatagcagcctctcctcaattacccttttagatccaggtgaacactactgctaaccagcatgccgatttcataccttatgctacacagacattaagaagagcagagctggcaccctgtcatcaccagtggccttggtccttaatcccagtacgatttgcaggtctggtttatataagaccactacagtctggctaggttaaaggccagaggctatggaacttaacactccccattggagcaagcttgccctagagacggcaggatcatgggagcatgcttaccttctgctgtttgttccaggctcacctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaaattgtgt

SEQ ID NO: 293233 - DNA, 5427 bp, Homo sapiens
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaaggagaaccctcacctaataataatgaatgtcagtgactgtatcccagatgctattgaagttgtaagcaagccagaagggacaaagatacagttcctaggcactaggaagtcactcacagaaaccgagttgactaagcctaactacctttatctccttccaacagaaaagaatcactctggccctggcccctgcatctgttttgagaacttgacctataaccaggcagcttctgactctggctcttgtggccatgttccagtatccccaaaagccccaagtatgctgggactaatgacctcacctgaaaatgtactaaaggcactagaaaaaaactacatgaactccctgggagaaatcccagctggagaaacaagtttgaattatgtgtcccagttggcttcacccatgtttggagacaaggacagtctcccaacaaacccagtagaggcaccacactgttcagagtataaaatgcaaatggcagtctccctgcgtcttgccttgcctcccccgaccgagaatagcagcctctcctcaattacccttttagatccaggtgaacactactgctaaccagcatgccgatttcataccttatgctacacagacattaagaagagcagagctggcaccctgtcatcaccagtggccttggtccttaatcccagtacgatttgcaggtctggtttatataagaccactacagtctggctaggttaaaggccagaggctatggaacttaacactccccattggagcaagcttgccctagagacggcaggatcatgggagcatgcttaccttctgctgtttgttccaggctcacctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaaattgtgt

SEQ ID NO: 293234 - DNA, 3703 bp, Homo sapiens
taggcaagcacctgtaactattgaagtggaggtctgttacctactagatacagtgcatgtatgtatttactttctaccttacacacttaaaacaatttacagttaattaaatctggagcattgctctatttgtttatatacagaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaaggagaaccctcacctaataataatgaatgtcagtgactgtatcccagatgctattgaagttgtaagcaagccagaagggacaaagatacagttcctaggcactaggaagtcactcacagaaaccgagttgactaagcctaactacctttatctccttccaacagaaaagaatcactctggccctggcccctgcatctgttttgagaacttgacctataaccaggcagcttctgactctggctcttgtggccatgttccagtatccccaaaagccccaagtatgctgggactaatgacctcacctgaaaatgtactaaaggcactagaaaaaaactacatgaactccctgggagaaatcccagctggagaaacaagtttgaattatgtgtcccagttggcttcacccatgtttggagacaaggacagtctcccaacaaacccagtagaggcaccacactgttcagagtataaaatgcaaatggcagtctccctgcgtcttgccttgcctcccccgaccgagaatagcagcctctcctcaattacccttttagatccaggtgaacactactgctaaccagcatgccgatttcataccttatgctacacagacattaagaagagcagagctggcaccctgtcatcaccagtggccttggtccttaatcccagtacgatttgcaggtctggtttatataagaccactacagtctggctaggttaaaggccagaggctatggaacttaacactccccattggagcaagcttgccctagagacggcaggatcatgggagcatgcttaccttctgctgtttgttccaggctcacctttagaacaggagacttgagcttgacctaaggatatgcattaaccactctacagactcccactcagtactgtacagggtggctgtggtcctagaagttcagtttttactgaggaaatatttccattaacagcaattattatattgaaggctttaataaaggccacaggagacattactatagcatagattgtcaaatgtaaatttactgagcgtgttttataaaaaactcacaggtgtttgaggccaaaacagattttagacttaccttgaacggataagaatctatagttcactgacacagtaaaattaactctgtgggtgggggcggggggcatagctctaatctaatatataaaatgtgtgatgaatcaacaagatttccacaattcttctgtcaagcttactacagtgaaagaatgggattggcaagtaacttctgacttactgtcagttgtacttctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaaattgtgt

SEQ ID NO: 293235 - DNA, 1608 bp, Homo sapiens
ggaagctgcagtgagctgagattgcaccaaaagaaccaacatgtactaaaataccagttgtgtaccaggtgctttgcatatattggtttgggatatattggttcagaggagacaattctgctccatagacatcagtattctgccatcatttttgatgactacctcagaacataaaaaggaacgtatatcacataattccagtcacagtttttggttcctcttttctttcaagaactatatataaatgacctgttttcacttagcatcctttggactctgcagtaggttgtctgggtcaagataactctcagtcacatttatattcatattatgctaaaatagtaaaatgaaacctcattgttggacataatttagatataactaaaaagttctatgaagtgggaaattccgtgttggctctggagcagctttgtctcctctgaaccaatatatcccaaaccaatatatgcaaagcacctggtacacaactggtattttagtacatgttggttcttttggtgcaatctcagctcactgcagcttccgcctcctagattcaaacaaacagttctcctgccccagcctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaaattgtgt

SEQ ID NO: 293236 - DNA, 1066 bp, Homo sapiens
acaacaagaccagcttcctcccggtgccccccccaaagcacctccagagcacctaggactccaggtgcatgctaccacacctgactagtttttatatttttagtagagattgggttttaccatattggccaggctggtctcaaactcctgaccgcaggtgatccacctgcctcagcttccccaagggctgggattacaggtgtgagccaccatgcccagcctatttgtcacattatttgtcacatttattttacttttatttattttttgagatgaaatttcgctcttgttgcccaggctggagtgcaatggtgcagccttggctcactgcaacctccgcctcccagggtcaagcaattctcctgcctcagcctcctgagtagctgggattacaggcatgcaccaccacacccaggtaattttgtatctttagtagagatggggtttcaccatgttggtcaggctgttctcgaactcctgacctcaggtgatctgcctgccttggcctcccaaagtgctgggattacaggcgtgagccactgcgcctagccgtcacatttctaaacaagcatgaaaggggttcatttttgtcttcttcttgcctgccgtcagcatggtggaaatggctctgcctatgctcatgcttctggtgcccaatgccttgcactgtgccattcaacactatgaagagaaacaagtagccacacctcaaaataatgtggctgtcaacaactggcctaaataaacctacacaaaccagtacttgccttttgctggaaacattgattatgtgctcctcacgtagtagaaagcggtatcctgattagtctaacagttgtgttagactttagggccagtattgtcagcatttatttatttatgtacctttgttatgatgggatatttttcatttgaaacttgttcataaaaatgtcaatgacattgatgactgatttgtacatatttttcatatagttttgtttaaaaaataattcacgcaaaatcttgaagtcatttttgctattgaaataaaccttaattaaaatatttcatcatcaaattgtgt

SEQ ID NO: 293237 - DNA, 2936 bp, Homo sapiens
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacaaagaggttgaggaagaaagaattgcaggcacagagggtggattctctctgtcttggaaaccccaacctggagatgttataggctatgttgtggactggtgtgaccatacccaggatgtgctcggtgatttccagtggaagaatgtaggtcccaataccacaagcacagtcattagcacagatgcttttaggccaggagttcgatatgacttcagaatttatgggttatctacaaaaaggattgcttgtttattagagaaaaaaacaggatactctcaggaacttgctccttcagacaaccctcacgtgctggtggatacattgacatcccactccttcactctgagttggaaagattactctactgaatctcaacctggttttatacaagggtaccatgtctatctgaaatccaaggcgaggcagtgccacccacgatttgaaaaggcagttctttcagatggttcagaatgttgcaaatacaaaattgacaacccggaagaaaaggcattgattgtggacaacctaaagccagaatccttctatgagtttttcatcactccattcactagtgctggtgaaggccccagtgctacgttcacgaaggtcacgactccggatgaacactcctcgatgctgattcatatcctactgcccatggttttctgcgtcttgctcatcatggtcatgtgctacttgaaaagtcagtggatcaaggagacctgttatcctgacatccctgacccttacaagagcagcatcctgtcattaataaaattcaagatctcttcaaaagtctggcttaatagaagatagctggattctcatacttgcttctacattcaatctgttgccatatgttgttttggctgaagtattaaagaaaatctagcctcacacagctgagccttcttgagacaccccatcactgcatccagaaatccccgaaaacttagagggaaccacttctaaaggattatggatagtctgctcacaccaatcagaatatggaatatcttgaaagtctgaagaaaaaaataattatttcaattaaagcaccataacggctt

SEQ ID NO: 293238 - DNA, 2227 bp, Homo sapiens
gcggccgcctccccccgggactgaagggagggaattcctgtgggtcccaggagtgccaagagtgcgcagcaagacgggaaattgcaaaagacctcacccctctgccctcccccgcggttttccagtaactcccgcccctccgcgcttgccccgcagctgattcatagccccggcccgggccgcctctgcacgtccgccccggagcccgcacccgcgccccacgcgccgccgaggactcggcccggctcgtggagcccttcgcccgcggcaaaaccagaactgatggctctatttgcagtctttcagacaacattcttcttaacattgctgtccttgaggacttaccagagtgaagtcttggctgaacgtttaccattgactcctgtatcacttaaagtttccaccaattctacgcgtcagagtttgcacttacaatggactgtccacaaccttccttatcatcaggaattgaaaatggtatttcagatccagatcagtaggattgaaacatccaatgtcatctgggtggggaattacagcaccactgtgaagtggaaccaggttctgcattggagctgggaatctgagctccctttggaatgtgccacacactttgtaagaataaagagtttggtggacgatgccaagttccctgagccaaatttctggagcaactggagttcctgggaggaagtcagtgtacaagattctactggacaggatatattgttcgttttccctaaagataagctggtggaagaaggcaccaatgttaccatttgttacgtttctaggaacattcaaaataatgtatcctgttatttggaagggaaacagattcatggagaacaacttgatccacatgtaactgcattcaacttgaatagtgtgcctttcattaggaataaagggacaaatatctattgtgaggcaagtcaaggaaatgtcagtgaaggcatgaaaggcatcgttctttttgtctcaaaagtacttgaggagcccaaggacttttcttgtgaaaccgaggacttcaagactttgcactgtacttgggatcctgggacggacactgccttggggtggtctaaacaaccttcccaaagctacactttatttgaatcattttctggggaaaagaaactttgtacacacaaaaactggtgtaattggcaaataactcaagactcacaagaaacctataacttcacactcatagctgaaaattacttaaggaagagaagtgtcaatatcctttttaacctgactcatcgagtttatttaatgaatccttttagtgtcaactttgaaaatgtaaatgccacaaatgccatcatgacctggaaggtgcactccataaggaataatttcacatatttgtgtcagattgaactccatggtgaaggaaaaatgatgcaatacaatgtttccatcaaggtgaacggtgagtacttcttaagtgaactggaacctgccacagagtacatggcgcgagtacggtgtgctgatgccagccacttctggaaatggagtgaatggagtggtcagaacttcaccacacttgaagctgctccctcagaggcccctgatgtctggagaattgtgagcttggagccaggaaatcatactgtgaccttattctggaagccattatcaaaactgcatgccaatggaaagatcctgttctataatgtagttgtagaaaacctagacaaaccatccagttcagagctccattccattccagcaccagccaacagcacaaaactaatccttgacaggtgttcctaccaaatctgcgtcatagccaacaacagtgtgggtgcttctcctgcttctgtaatagtcatctctgcagaccccgaaaacagtgtgtcaacgtgtttcagtgggacagtcccctcagtgtggggagaaggagacttcagccatggctcaggacatttctgtccaggggattcttcaacatacatgggaaattatctcaaatttattcaagtaactgcaaccctaacaaacagtcaccactgagagttggagttactatttatgatctttgtggcttgtgaaataggaattgcatttactattttgtaaaaagtgttgtcagtctttgcacctggaaagagtccatgaacatttccagagatcatcagaactggcatcaactttcaccacagactctgccaactttgtagaataaaagataataactggctaatctcttgcc

SEQ ID NO: 293239 - DNA, 357 bp, Homo sapiens
agcaatcatgcaattatcagagtggtaatagtaatgtgctgtctgtggcagtaagagcaacagcagtggtatcagtgtaacaataggagcagtggtggaaaggattgtcttgcatgcaccagagggtagaggtttggcagagaaatttaggttgctattttctccaggaggtagaaaaagctaaagttatctgctgaaggcaaatggataacttgttttaagaggcttgaattttgagtgcgattctaacttggctatttttttttcttgcagtacaagattctactggacaggatatattgttcgttttccctaaagataagctggtggaagaaggcaccaatgttaccatttgtt

SEQ ID NO: 293240 - DNA, 651 bp, Homo sapiens
ccaacctggagatgttataggctatgttgtggactggtgtgaccatacccaggatgtgctcggtgatttccagtggaagaatgtaggtcccaataccacaagcacagtcattagcacaggtaagaagaagcttccatatcatcgcattgctatattcaccttgaagaaagttcaagtgggatttctggactacttcacagactttgactgtgctaagctagtaattttgaaacgacaaatccagcatgggtgttaggagttcagatgttacaagaatatgttctaaaacttgacctttaaatctacttttgcagagaatatctgcacatgaggtgggaactgattttcataaacttgtttctttaaattagtgcatagtctcgaatggcagaaggacattattataacagttgtccagagagcttttacaaaagcagagacttgcatccatttggaagatgtttaggacatatagttgatgagaatcgatcatcaacttcagtttcaatagaacatgtagaacttgttctcttacctcccacattggatttgtaatgtgaagattgctagtttagcagtcagaggagtgctggtttgtgtggcttgagctggaggggtgggtggcgccatctactgggctcagggaaaggt

SEQ ID NO: 293241 - DNA, 365 bp, Homo sapiens
ttggctagttggttggttggcttttcccctgaagtcaggcagaattcatattacaacttgcatacataatttgagaaataataaacatgtaaaattactttcaatcataaacttgtatttattcctttgaggaagggaaaagtacttattaaaaatgtccctttctttttcctcgttcagcctcgatgctgattcatatcctactgcccatggttttctgcgtcttgctcatcatggtcatgtgctacttgaaaagtcagtggtaagtgtgtgaggaaggttttatccaagaagagagtaagagaaaagtctggaaagagatttagtaagatagaaatgacattgaataatatgaaacaacgtat

SEQ ID NO: 293242 - DNA, 1189 bp, Homo sapiens
aattcgcggccgcgtcgaccgagaagacgacagaacggggcccgtagtccttctgcgagggcgcgaggactccaggagccgtcctggttcgagcatttctgaagaaactgagttcccggcgttcgcagcctgggagtcacaggcgcccacccaccggtgttggaagggcatgagaaacaaggggagaacaagggcacccaaagcctgacccccacaaggctagaggagcaacaggaaaattcgtttccagagactgattcctcagctgctgagcaggagcctggagccacacttgctgcctggtactactgacacacaactggaaccaccgctgtggcctggggtgccaccagaagccagagattagaattgctttccccatctcatatcttccaaactcccaccagtgcctcccactggctgagtcagatgacaagggagtctgggaaatgtagttgtttggcttccagccctgaccatggagagtatagaaaggcaggtgtaggggagaaaatagatgccattcacacagcgcctatcttgcagggctgttttgaggagtaaaaactcagcctatttttattcctcatagcatgtagtagcattcagggaaaggcaaatcttccaaaacaatatcttaggtataatagttctacataaaggtttgaatttaccattaaaagcatcaaaatgagcattttaaaagtagaattttaagtctgaatgggcagtatattcacatggtataaaattcaaattacaaaacaatatacagtgaaaaataagggggtttttttgctcatcttcttgtgacctggctctttccatctctgtccacaaccctctgcaggcaataactggtacctttgttatggatcctctgcagatataaagtagacatatattaacaaatgttttctttggcccagaggatgcatattatgcacattcctccatttcttgtttgtttttgttttttccacttaattgtatcttggagatcactctgtatcagtatatatctgatttgttttagcagtacatgataatccattgtttggatatgccataattgtatcagccagtctctggacagtcttttactatttcaaggagtgctgcagtaaacatgtttgcgccacttcctggtacccattgcaaataaaactgggataatttcctgacgaga

SEQ ID NO: 293243 - DNA, 1117 bp, Homo sapiens
gctggagtgcaatggtgccatcttggctcactacaacctccgcctcccaggttcaagggattctgcctcagcctcctgagtaactggggttacaggcgcgcgataccacgcctggctaatttttctatttttagtagagatggggtttcgccatgttggccacgctggtcttaaactcctgacctcaagtgatccgcccgccttggtcttccaaagtgctgggattacaggtgtgagtcaccgtgcccagcctggacttgccttttacctcatccgtggtgtcttttgaagaaaaagattctttagaaatgttttttctttcatagcttgtgttttatgtattactttcaagatcccaactagatctaggtcctaaaaatagtatcctacctattgtttttttaatcaacttaattgtggtataattgcacactgcagataaactgcacatgtttgaagtgagtaatgtaagtttttttgtcttggagccctgaggtaaacttttatttcttagctgacaggacttccacacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggcgccgccctgatgtgtagtctccaggccgccccgaacaccagcccagcgggtcctggacccctaggtcatgtggctacagtggaatccaggcttggccgaatccaggacgaccaggccagacccac

SEQ ID NO: 293244 - DNA, 855 bp, Homo sapiens
cgccctgcctgggcggggttgggacctttctggcacctgcgtcgaagccggcggcaggatggactttgttgtcccggtcccagaccaccctcctccaccgtcgcctcccactgcaaaaaggcctggataaggaacctaattcgagctacccttctctgtgaagctcgacggctgagaacgtcagggctcgttcccaagtctctttccagaggccaggctttatgggagcatgggttaccagcgacgcaccctctgacaggacttccacacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggcgccgccctgatgtgtagtctccaggccgccccgaacaccagcccagcgggtcctggacccctaggtcatgtggctacagtggaatccaggcttggccgaatccaggacgaccaggccagacccac

SEQ ID NO: 293245 - DNA, 929 bp, Homo sapiens
gaaggatcatacatcactcaatcatcagcaaacatttatgaagcacctgctctcgtgcccagcctggacttgccttttacctcatccgtggtgtcttttgaagaaaaagattctttagaaatgttttttctttcatagcttgtgttttatgtattactttcaagatcccaactagatctaggtcctaaaaatagtatcctacctattgtttttttaatcaacttaattgtggtataattgcacactgcagataaactgcacatgtttgaagtgagtaatgtaagtttttttgtcttggagccctgaggtaaacttttatttcttagctgacaggacttccacacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggcgccgccctgatgtgtagtctccaggccgccccgaacaccagcccagcgggtcctggacccctaggtcatgtggctacagtggaatccaggcttggccgaatccaggacgaccaggccagacccac

SEQ ID NO: 293246 - DNA, 504 bp, Homo sapiens
gaaatcgcccgaggatggatccgacttgtggtttcaatggagccctcattcttctcttcacttaccctctccgtgaggaggaagccagtgcacatcaagcgtttcctgtgtagcacagactcttctcccaaacatctttgcattctgcactggtgagggccagtggtgccacaccaatgtcccaattcaccttgggaacgtccttgagcgcatttctttttgtctgtagaagtaaaagagtagaactgaatgccgaagccagcaagctgttggaaccttggaaacgcagagggcatgaaggctgagtccggggtcctacagtcagaggctcgcattcaaatcttgcctctgcctgtaattgccgtgggaccctagcaggtgacttagccatgccctgcctgggtttacctacctgtaaagagcccttgtaaggatgaaagtaggtggcacagaccaagcatctgtacctggcagaccagtccttaataaacacgaattattgtt

SEQ ID NO: 293247 - DNA, 450 bp, Homo sapiens
cgctttcggggaaggcctgcaaagtgaggcctcgggctagggttggcgggcgcgtggtgggaaccgcgtggaaccgaagggctcccacgggaacaagggcatcactgacggtacggcctctcgggtctattgacccttctctgcctccccggtccggactcatacaacttggaggcccagaggtcgtccagtctcatcttgacgtcagaatgacacagccagttatcaaaagaaatcttcaaggaattccctgtatgctgaggaatgaaggatgtgagaaagaaattaactgtcttccgctctcaagttagacccctaagaaaactcttaagagtatctaataactagaggcatctgtcacaccagcaaagatgtcattattgtttttttcttatcagtcttagattatgctttgctttaaaatgagatacaccaccagagctttccaga

SEQ ID NO: 293248 - DNA, 978 bp, Homo sapiens
cctaaggcctagctcagctgccacgtcctatctggatcatgccccccacaaccccgagaccatcttgaaccctccggcaagtgagcgcctccactggtgcacttaaacaccaacagtagtacaacagcagcgcatgactaccctccccacaggctggcaaatgcccatgggagccagtgatccagcctgctctagtctgtcagaaaggctgctcaggaccagattacaacctggagaaagccttccaacgcaagagccatccacagccagtttcaccactaatttcaaggattacactaggaacaagagcaaatctaccactatcaccccagactatgcccatcatctccacctctcccgctggaagaggtgacaatctattgtccacacaggagccagagaaaataccttaaaacggatgtcgggtcctgtcagacctttgctcaaaaccctctgaggcttctgatcattatctgaataaaatccaaactccttaccatgacctaaagggttcatagcctggtcccttacccaagccctcctcactatactctgtccacagtacccttctttatttttcttccttgaatatgcaaagcttgagacttctgcttcctgacaaggagcaagaggaaccagatacaccctcctgcctgaaacaaccaaaaaaaatgggcaaaatatatgaaacagtggttttcaagacactacacatggggcaacaaagcacagtgattcctgcgagacaggaaacaaatgtgatgagcccttcaactgccccagcataccacacctgagagtttgcaggccacagaacagaggggagactcatggagagccctgaggactccgtgagttgggaggatgaaactgaaagtccagggagatcaaggcagctagagttcacaggatagagtactggagaaaagagcagagagagaactcgagacctacagaaggtcctcaagtatgcagggg

SEQ ID NO: 293249 - DNA, 1130 bp, Homo sapiens
ggatcaggcccaaaaagcaagggacaaaagggtctccagaagcggaaacaaaagatacaggtggcacctccactcagcgccttggagagcttctgagctccccaaggatgcagcctctgcagttctgcccatgacagaaaagaattgggcgggggggtggcacagtgctgactccagggaacacagatggagctaaggggccccctgaatcaagtcaagggatcacagaccaggactcccacatgcacataagggtcaaaaggtcagagaggctcaaagtttccaaaagaactttggtacagagaagctggcaagatagagcaggcgacaacagttcccacccgaagaatgtcatgcctggagttctcatgtatgtaattcacacttccaggccttccaacgcaagagccatccacagccagtttcaccactaatttcaaggattacactaggaacaagagcaaatctaccactatcaccccagactatgcccatcatctccacctctcccgctggaagaggtgacaatctattgtccacacaggagccagagaaaataccttaaaacggatgtcgggtcctgtcagacctttgctcaaaaccctctgaggcttctgatcattatctgaataaaatccaaactccttaccatgacctaaagggttcatagcctggtcccttacccaagccctcctcactatactctgtccacagtacccttctttatttttcttccttgaatatgcaaagcttgagacttctgcttcctgacaaggagcaagaggaaccagatacaccctcctgcctgaaacaaccaaaaaaaatgggcaaaatatatgaaacagtggttttcaagacactacacatggggcaacaaagcacagtgattcctgcgagacaggaaacaaatgtgatgagcccttcaactgccccagcataccacacctgagagtttgcaggccacagaacagaggggagactcatggagagccctgaggactccgtgagttgggaggatgaaactgaaagtccagggagatcaaggcagctagagttcacaggatagagtactggagaaaagagcagagagagaactcgagacctacagaaggtcctcaagtatgcagggg

SEQ ID NO: 293250 - DNA, 1065 bp, Homo sapiens
aaaacttctagaagataatgtaggagaaaatctagatgaccttaagtttggtgatggcttattagatacaacaccaaaagcacaatccttgaaagaagcaattgataagttctgtgtcattaaaattagaagcttctgctctgcaaaagaattgtcaagagaatgacaatacaagctacagactaggagaacatatttgcaggggacatacctgataagggacttacattcaaaatacacaaagaactgttaaaactcaatagaaaacaacccaattaaagaatgggcaaacgatctgagcagacacctcaccaaagaaaatatacacatagcaaataagcataaggaaagatgctccatatcatatgtcagtagccatttcaaattgaaacaataatgatgtaccactactcacctattagaatggctaaaatccaaagctgacaacatcaaatgctgacaaggaggtggctcaacaggaactgtcattcattgatggtgggaatgcaaaatgacacagctactttgaaagacaatttggcggtttcttgcaaagctaaacatattcttaccatgtgctacagcaatcatgttcttcggtattaacccaaatgagttgaaaacatatagcaacacaaaaacctctgcacagatgtttatagcagctttattcataattgccaaatcttgtaagcaaccaagatgttcttcaacaagtgaatggataaatgaactgtaatatgttcatacaatgaaatacggcagggcttgatggctcatactgttaattatagcactatgggaggccgaggtgggcagatcacttgaggtcaggaattcgagaccagcctggccaacatggtgaaaccccatctctactaaaaatacaaaaattagccgggcacggtggcatgcgcctgcagttgcagccacttgggaggctgaggtgggagaattgcctgaacccataaggcagaggttgcagcgagctgagatggagccactgcactccagcctgggcgacacagtgagattagaagaagcaatattgttaaaatgttcata

SEQ ID NO: 293251 - DNA, 1065 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatga

SEQ ID NO: 293252 - DNA, 1238 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgaaaaaaaaaaaaaaaaaaaaaaaaaaaaaaaaaaaaactcgggggctttttttggggggggggaaaaaaggggtttgaaaggggatgggaataggtgtttcgggcccctttttttgtcaaaagggggaaatgggggggccccaagggaggggaaaaaacgaaaccggtaccgag

SEQ ID NO: 293253 - DNA, 1017 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactgggttggggggcggcaagcaaggaggcccgtccccttttttgcggtgaaaagccggcggaacatccccccattcgcaa

SEQ ID NO: 293254 - DNA, 846 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgctatgaacttctaataatagggaccagctcgatga

SEQ ID NO: 293255 - DNA, 1018 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatga

SEQ ID NO: 293256 - DNA, 1245 bp, Homo sapiens
  misc_feature (154)..(154): n is a, c, g, or t
ggggggccgtcggaagtagtctgatgctcggtctcggttgcccagaggaggtcttcgaagatagggtcatcggtgcttacagctgagtaatttcgtagataggctgtgggtgtgtgatataccgtggtcatgatattcggcgggtcctcggatncctcggttgagtggtgatccaatagtggcagtcagaacctatgtctgacacgagagggtttagttgagatcttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgaaaaaaaaaaaaaaaaaaaaaaaaaaaaaaaaaaaaactcgggggctttttttggggggggggaaaaaaggggtttgaaaggggatgggaataggtgtttcgggcccctttttttgtcaaaagggggaaatgggggggccccaagggaggggaaaaaacgaaaccggtaccgag

SEQ ID NO: 293257 - DNA, 1752 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcaggtgcccgggagggaagttgggggcggggcctgtctctctggctttgtaggggcggggccaagaaagtgttctggctgggagtgggcataaatttaggaaactgattcgaggcggggaggacaggcgggaaggccgcaggtggagggttcagcggaggccggcttctctcagtacttggtaaatacgtaggggagttcgtttcctgagctccggtaactgcctgaccttgtaggccttgtacctctttgcagagagagccaggtagagctccgggaacaaattgacaacctagccacaggtgagtgagcatccctgtgtacccggaattcttcagcccactttcaggaccttaggtttttgccaacccctgggctgagtttctgtcacttgcttccagggcatcagggctgccaaaggactcctcctttcagggatgtcttaaatctctaatggctgtggcccgtttgggtgcaagtgttttccatcccattaccagcctgctttccctcagaacaagagataagccgttagatcttagctgcaccttacttccatccccagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgaaaaaaaaaaaaaaaaaaaaaaaaaaaaaaaaaaaaactcgggggctttttttggggggggggaaaaaaggggtttgaaaggggatgggaataggtgtttcgggcccctttttttgtcaaaagggggaaatgggggggccccaagggaggggaaaaaacgaaaccggtaccgag

SEQ ID NO: 293258 - DNA, 1012 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattagggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatga

SEQ ID NO: 293259 - DNA, 1489 bp, Homo sapiens
ccccgggacgactaggctaggtacgaggcctggtgtctaatcggccgaggggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcaggtgcccgggagggaagttgggggcggggcctgtctctctggctttgtaggggcggggccaagaaagtgttctggctgggagtgggcataaatttaggaaactgattcgaggcggggaggacaggcgggaaggccgcaggtggagggttcagcggaggccggcttctctcagtacttggtaaatacgtaggggagttcgtttcctgagctccggtaactgcctgaccttgtaggccttgtacctctttgcagagagagccaggtagagctccgggaacaaattgacaacctagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgaaaaaaaaaaaaaaaaaaaaaaaaaaaaaaaaaaaaactcgggggctttttttggggggggggaaaaaaggggtttgaaaggggatgggaataggtgtttcgggcccctttttttgtcaaaagggggaaatgggggggccccaagggaggggaaaaaacgaaaccggtaccgag

SEQ ID NO: 293260 - DNA, 973 bp, Homo sapiens
tcaggagtctataaaggcgagtcgggtagaacttgacaagttagccacagaactgtgccgcataaatgaggatcagaaggtggccctggatcttgacccctatgttaagaagctacttaatgcccggcgacgcgttgtcttggttaacaacattctacagaatgctcaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacttgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgaaaaaaaaaaaaaaaaaaaaaaaaaaaaaaaaaaaaactcgggggctttttttggggggggggaaaaaaggggtttgaaaggggatgggaataggtgtttcgggcccctttttttgtcaaaagggggaaatgggggggccccaagggaggggaaaaaacgaaaccggtaccgag

SEQ ID NO: 293261 - DNA, 588 bp, Homo sapiens
tttcaatcgtctactttccttttaatatatgtagcatttcagagtacataaggctcatgaaagaggaggtacagatcctccggggggaaaacctggttaagcctaaagcatagtggaaaatggaaagatcaacaattagtacagaacagaaaaatgattttgaggattgtattaaggaagttttaaagaacaagaaatcagctctagaaaataaatgtattttaggagtgacaaggccagtccctggaaatacatttgactattaaatttttatttaacttcttcacccaaaattaaacagttccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgctt

SEQ ID NO: 293262 - DNA, 430 bp, Homo sapiens
acagaatctacagaaaacccgctttgaggttactggcctgatggaagacacacaatatcaattccgtgtgtatgccgttaataagattggatacagtgaccccagtgatgtgccagataaacactatcccaaggacatcttaattccacctgagggagaacttgatgcggacttaaggaagacactcatattacgtgctggagttactatgagactatatgtaccagtaaaaggacgcccacctccaaagattacttggtctaaaccaaatgtcaatctaagagacaggattggactggacataaagtcaactgactttgacactttcttgcgctgtgaaaatgtgaacaaatatgatgcaggaaaatatatcttaaccctggagaacagctgtggtaaaaaggaatataccattgttgtgaaagtgctt

SEQ ID NO: 293263 - DNA, 3527 bp, Homo sapiens
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggagggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293264 - DNA, 3479 bp, Homo sapiens
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggagggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293265 - DNA, 3620 bp, Homo sapiens
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggagggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttacacacacaccaaccacaacacaagcagacaaaataacaacaacaaacaggataaccaaaacaaaaacaaaaaaactgggtgcggcccaccaca

SEQ ID NO: 293266 - DNA, 3107 bp, Homo sapiens
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggaggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293267 - DNA, 3399 bp, Homo sapiens
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggagggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293268 - DNA, 1407 bp, Homo sapiens
cctagttttagaagtttcaatagcaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293269 - DNA, 1037 bp, Homo sapiens
aaataaaaacaaacgaaaccgcagattacgatatagacagacaaattcagaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293270 - DNA, 1042 bp, Homo sapiens
tcacgacacccattactccccgttatcactcattcttattaagaaggtagtcgagaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293271 - DNA, 1042 bp, Homo sapiens
ctgtttaagttgtttggtttgtgtgtgtgttagtggggagcgaaccgacgcctagaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293272 - DNA, 1036 bp, Homo sapiens
tacacattgtctataaacgcaatactaacttttcacctcttctatctagaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293273 - DNA, 1045 bp, Homo sapiens
atgaatataaagaatgtgtgtccgcgtccgtcatagtatagaggatgaattcgtgaggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293274 - DNA, 1038 bp, Homo sapiens
tcaccaataccatctctctcttcacgtcacacaccacaaccgaaactttagaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293275 - DNA, 1038 bp, Homo sapiens
cgcgttcgacataactaacgcgcgattagcaaaacacccacccccctttagaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293276 - DNA, 968 bp, Homo sapiens
tctgtgactacccagtctggactacccagaatatattgcttcatctgccttaaagaagatacaaggcctgtttttagtttataatgatggataaattcgttttaatctagattactaatccttcttttcaataattcttctaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcattta

SEQ ID NO: 293277 - DNA, 2886 bp, Homo sapiens
  misc_feature (1987)..(1987): n is a, c, g, or t
  misc_feature (2099)..(2099): n is a, c, g, or t
  misc_feature (2414)..(2414): n is a, c, g, or t
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggagggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaccggacggcttgaacctggcatgtacataagttacgtagctgacttcatagcccaggaccaccctggctttatgccagcgggacagaagcttatggacaggtaatggtgcacaatagcctgttgaaatgactcgttacngtggttccaaagttttttctgggaacaacaaagcgggccgttaagttacacaaaggccgggttataaaaccaatggccccaagctggaccggactaccgacacggaattctnttaaacacgtggcacgaaagcgtccattccagttaacaagcggaacagacaggctggggccccaaaaggggccttgggggacaacacacaaagtggccaaggaaaagggggaactttggctttttcccaaagggaccgaaataggttctccaaaagggggaaaacatttcgtcagctgctagggcgggcccaatagtccccctttggtaacagggaaaaggcgccctttcccaagaaagagagattctcgaaaagcgcgcaacatttacgcttgcgttaacaccgggggaacttggccgctttctattacggaancttccgtttggccgaatggaagcacccaaagaggattaccaatgggccaaaccttttaaagacatcgggggacaaaacaccgccaccggcaaagcaacaagtcttttttgaaacgacacgccggacaacagatccatctttcccagagtgccagaaaagggaattcagtgtactgacccacattttcgatgtgagagctattagactcacgcacatttgttgtattgtacccggaaaaagaaatcgaagacgtagacgaaagcgcaacggttttttaatgacaaaggccgctgtttggcggacgacacacctttttcatcatcttctggaggcacccccaaaagggggagaaacgaaagagagcagcgtccactaaaagaatagggccatgttttcccccaacataaagtggggctgccccagaaagtagatccccaacagagaggggccagacaggcaggcgcacacatca

SEQ ID NO: 293278 - DNA, 2497 bp, Homo sapiens
taggctacgcctcggcctctccgctcgggtcactgcgcatgcgcaggaacgcaagctagcgctttggtgtgcgtgttcgtttttccctttgaatggccgtttacggcaccggcaggccccggatgaaagaactgaaatccagaaaagttcacatgcaacgaacaatgggacagaattggaaccagtgaagccggaactcactacaccgtcccctaagtgacgccaaaatgcactttctaacgtctccggagggaagtgcgcttgcgcaaatgctaggttacacttgagtaactccgggaatgactgggtgggtggggcggggaacagtaacggtctcctattggatggcagcctaaactcgcaggccagctaattggacgcaatcagaacccagcattctttcttcgtgttcctgtgcgggattggtgtgcccaggggtttggctttccaattggctaacgccggggtgggtggggaatgtggggagatttgaatttgaaaccggtagggagtgataatccgcattcagttgtcgaggagtgccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagaaggaatctcaaaagaatgataaagatttgaagatattagagaaagagattcgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaagcagggtggactgggtatggattatgttctataagtacgttctgagtccttcctgcatatcaggcagggacaaaacggtgaaagtcccatgcaccttggcgacgtgcaggaggaaatgacatgattcgtgctcagcctcatccattggtctgaatcaattcacgtctcatgagcccagggaacacggtgttccacctgaacgcggatcctagaggccagtgcagaagcagcatgggtaaccactcacaacgatttatctactgctcgtgaaatctctggatttaactgtgatgaaagaccggaggctgaaggagaacttcaatatcatatattttaacaggttgactcacagtatggaacaagaattaaagaaccacggaacttcaagagctgcagaggagccgcttctaacatcaggacatcaagaaagctggaacggcggatggccggagaggggactctagtatggggtcacagagatgggtcgcagagatggaccgtgtggaagggtatggattctcacgcccactactgaccctagatgtcctgagtgaccctccccatctgtacgatcttgagataacatgcaaaacactttacgactacttggcaaaaaaacacaaatacaaactcacgaaggcaatctata

SEQ ID NO: 293279 - DNA, 365 bp, Homo sapiens
tttgacttttttttctttttaataagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggtatatagagcaaataatggccttagaaccattaagacaatttaatgttgaaagccagctagtaactgtcccttggcttgcttttggccatcttatactgcaaattaagaatttactcagttaaaaaatgacacttcttgaagagttccttgaggtttaaaaaaaaaaaaggaaaaattaatgaaagtggct

SEQ ID NO: 293280 - DNA, 1307 bp, Homo sapiens
ccgatgaagatgccgttttcgccgatgaagatgccgatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaag

SEQ ID NO: 293281 - DNA, 462 bp, Homo sapiens
ctcctaggagccgaagggacgggaggccgcgtagaggaggggaccgtccccgagcctcgccgagcctgcggtgtagacacctctggtgtctagtggttgaggatctgttgaccgggcatggtgggtagaaggaacgctccgagcagaagaaaagtggtgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaag

SEQ ID NO: 293282 - DNA, 417 bp, Homo sapiens
gtggcttgcaagaggacaagcccccagtgagtagggtggtgctagcccgggggtctgcctggcttcaggaaaggacgaccctggactcccatggcccagctgggttttcaaggtttcaagggtgggcgggatttggatggggctccatctgggtgaggagatgatgggatgaaggccctagaggtgggcatgaactaggtagatctgggaccaaagagagaagaggcaggaggaggttgaggtagtgtgagatgagctgggtgggctggacttggggcctaagggctaccctgagaagttgaccccaggaaggaggaaggcttataaactggggtggggagaaaggaattgagtgaaattgctgctctgggacttggtgcccccgtcctactctgggcagcccctgcctgcctctcc

SEQ ID NO: 293283 - DNA, 408 bp, Homo sapiens
tgctgggattacaagcgcgagtcaccacacacgtctggcattaatcttaaatctaactgcttacctactatatcctcatctgcagccaaccacattttcacaaaactccacaataatccaatttcaaatgcccacagttaacaatagtattacagttgttaaaggagaatcacttgaacctgggatggtgaggggctgttgggctggctccgtcgcagaggggagatgggaaaggctgacaactgtgcccacccccagggtatattcaggcctgccgggcactcatgatcaccgccatcctcctgggcttcctcggcctcttgctaggcatagcgggcctgcgctgcaccctccattgaacagctatagccctgaatgaaaattcactaaacgtccttttaccctcaa

SEQ ID NO: 293284 - DNA, 1447 bp, Homo sapiens
ccgatgaagatgccgttttcgccgatgaagatgccgatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggctccacagactccccagcctcactgtcggggggcactggtctccttgtccggctgatgtctataaagggcccctgtgaagggaggcgtcttgcaagttgcaggttgagcgtccgctgtaaggaggcggtgtgtgtgcagggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaag

SEQ ID NO: 293285 - DNA, 1427 bp, Homo sapiens
gcttggctgtatccgtcagtggctccaggctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggctccacagactccccagcctcactgtcggggggcactggtctccttgtccggctgatgtctataaagggcccctgtgaagggaggcgtcttgcaagttgcaggttgagcgtccgctgtaaggaggcggtgtgtgtgcagggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaag

SEQ ID NO: 293286 - DNA, 1287 bp, Homo sapiens
gcttggctgtatccgtcagtggctccaggctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaag

SEQ ID NO: 293287 - DNA, 1852 bp, Homo sapiens
ccgatgaagatgccgttttcgccgatgaagatgccgatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggctccacagactccccagcctcactgtcggggggcactggtctccttgtccggctgatgtctataaagggcccctgtgaagggaggcgtcttgcaagttgcaggttgagcgtccgctgtaaggaggcggtgtgtgtgcagggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtaactgggggaaggtgatggggcgggggtccccctcaaccgcagacttcaggctgctttgtcctcatctaatctcctctccaattcccactcctcatgctcacctcccctaccctgctgcatggacacctgctcacccctgcctcatctgtactccccagatctcctggctgcaaatcagcccatcggcagtgtttcttgagctcccagtaggggctggccacggccaggtgtgggagggacttcgaagataagagtgagcggctgcctccgggagcttacatcctagctggggagcagagttagggtgcacgctatggcgcacacacacagtgcacgtccacagtgccataccacggggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgcccggcggccctaccaggctccagtgtccgtgatgcccgtcgccacctcggaccaagaaggcgacagcagctttggcaaatacggcagaaacgcctacgtgtagcagctctggcccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgaccgttaaaaaaaaaaag

SEQ ID NO: 293288 - DNA, 1297 bp, Homo sapiens
  misc_feature (1295)..(1295): n is a, c, g, or t
ccgatgaagatgccgttttcgccgatgaagatgccgatctcgtcaacagctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctggctccacagactccccagcctcactgtcggggggcactggtctccttgtccggctgatgtctataaagggcccctgtgaagggaggcgtcttgcaagttgcaggttgagcgtccgctgtaaggaggcggtgtgtgtgcagggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccggtaactgggggaaggtgatggggcgggggtccccctcaaccgcagacttcaggctgctttgtcctcatctaatctcctctccaattcccactcctcatgctcacctcccctaccctgctgcatggacacctgctcacccctgcctcatctgtactccccagatctcctggctgcaaatcagcccatcggcagtgtttcttgagctcccagtaggggctggccacggccaggtgtgggagggacttcgaagataagagtgagcggctgcctccgggagcttacatcctagctggggagcagagttagggtgcacgctatggcgcacacacacagtgcacgtccacagtgccataccacggggcatggtggctcatgcctgtaatcccagcactttggtaggctgaggtgggtggattacttgaggtcaggagttcaaaaccagcctggccaacatggtgaaaccctgtctctactaaaaatncc

SEQ ID NO: 293289 - DNA, 1357 bp, Homo sapiens
gcttggctgtatccgtcagtggctccaggctgccgcgcgcaggcttagctcattcctctgacctgccaggaagcagagagacccacagagcaggagggaggcagaaagtggagacggacctgagcccgaggaagaggcaggcagaggctgaggctgattccaccccagcctgcctggacaaccctccttagccgcagccccttccagttccctaggggttctgcccctccccctctctggggcaccagccccccagggtcctgcatcccaccatgtcgatggctgtggaaacctttggcttcttcatggcaactgtggggctgctgatgctgggggtgactctgccaaacagctactggcgagtgtccactgtgcacgggaacgtcatcaccaccaacaccatcttcgagaacctctggtttagctgtgccaccgactccctgggcgtctacaactgctgggagttcccgtccatgctggccctctctgggtatattcaggcctgccgggcactcatgatcaccgccatcctcctgggcttcctcggcctcttgctaggcatagcgggcctgcgctgcaccaacattgggggcctggagctctccaggaaagccaagctggcggccaccgcaggggccctccacattctggccgatctcctggctgcaaatcagcccatcggcagtgtttcttgagctcccagtaggggctggccacggccaggtgtgggagggacttcgaagataagagtgagcggctgcctccgggagcttacatcctagctggggagcagagttagggtgcacgctatggcgcacacacacagtgcacgtccacagtgccataccacggggcatggtggctcatgcctgtaatcccagcactttggtaggctgaggtatctgcgggatggtggccatctcctggtacgccttcaacatcacccgggacttcttcgaccccttgtaccccggaaccaagtacgagctgggccccgccctctacctggggtggagcgcctcactgatctccatcctgggtggcctctgcctctgctccgcctgctgctgcggctctgacgaggacccagccgccagcgccgggggcctacaggctcagggtcgtgatgccgtcgcactcggacaaagcgacagcagttggcaatagcagaacggctagtgtagcagtctggcggggcccgtgctccactgccagggagggctggcgggccatcctaagaccggggggagcccccgccccgaggccgtggcaggcccggaagggggggatccgggggccccggggggggggcggggaacacagggacaaaccggggggctggcagatagaagaagac

SEQ ID NO: 293290 - DNA, 278 bp, Homo sapiens
gaaggaggaaggcttataaactggggtggggagaaaggaattgagtgaaattgctgctctgggacttggtgcccccgtcctactctgggcagcccctgcctgcctctcccctaagccccctcccccactatccctccccctggactggactggggtcgtcctccggtccccaggtatctgcgggatggtggccatctcctggtacgccttcaacatcacccgggacttcttcgaccccttgtaccccggaaccaagtgagtgaggaaaccccccaccc

SEQ ID NO: 293291 - DNA, 303 bp, Homo sapiens
ccgtgggccccgctgtcttcccactgccccaaggagaggggacctggccggggcccattcccctatagtaacctcaggggccggccacgccccgctcccgtagccccgccccggccacggccccgtgtcttgcactctcatggcccctccaggccaagaactgctcttgggaagtcgcatatctcccctctgaggctggatccctcatcttctgaccctgggttctgggctgtgaaggggacggtgtccccgcacgtttgtattgtgtataaatacattcattaataaatgcatattgtgacc

SEQ ID NO: 293292 - DNA, 1873 bp, Homo sapiens
cgaccccaggttccccacgccccgggccgggccgcagcctcctgggcttcgtgggggcagacccagcctttcccggcagcgagcgctcggccaggtgcactaggcgctgtgcgggccccccttccccgcgagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaaca

SEQ ID NO: 293293 - DNA, 704 bp, Homo sapiens
atgtgctgaggttatctagaggatcccgtttgggctccagtcatggggacggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaaca

SEQ ID NO: 293294 - DNA, 308 bp, Homo sapiens
ctgcagtcctagccctcctctgtaaagggaggctgtacaggacggttgcacactgccggcgcccagatcatcgggctgctccctccaactctctccagagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgacaagtggtgcaagcccgacaggtcaatagtgaggaggactcg

SEQ ID NO: 293295 - DNA, 1837 bp, Homo sapiens
cgaccccaggttccccacgccccgggccgggccgcagcctcctgggcttcgtgggggcagacccagcctttcccggcagcgagcgctcggccaggtgcactaggcgctgtgcgggccccccttccccgcggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaaca

SEQ ID NO: 293296 - DNA, 1759 bp, Homo sapiens
cgaccccaggttccccacgccccgggccgggccgcagcctcctgggcttcgtgggggcagacccagcctttcccggcagcgagcgctcggccaggtgcactaggcgctgtgcgggccccccttccccgcgaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaaca

SEQ ID NO: 293297 - DNA, 396 bp, Homo sapiens
aaaataatccaaggtggcacattctgggtgacgtattttgatcccctgcccctcctgaggagggtctctggggtgggtgcagtttcagcgagcacaactggactctaggcaggaggtggggggatcgctgatcccaaatcctgcggtttgtgtgtcccacagttgaagctggaggaggacatggagtaccttcgggagcagatcaccaggacagggaatctgcaggccagggaggagcagagcttagccgagtggcaggtgggtgcccagggctgtccagtccctttcctgctgctgctccatcttcctgcatttccacgtctgtgtctgcccgtggggatatgctgccgcagtggcaggaaaagaagaaagttgcctctacccttctaggttctg

SEQ ID NO: 293298 - DNA, 1548 bp, Homo sapiens
cactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagt

SEQ ID NO: 293299 - DNA, 981 bp, Homo sapiens
acattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtctttcaaattctccccttattcacggactaccagactccgtgggatccgtctagggagttgctccacggtgggaagggttggaattcgttccttcaaaagtccaatttatgcggagccaac

SEQ ID NO: 293300 - DNA, 1267 bp, Homo sapiens
ctctcgctcttgccctctggggacccaaaaggcccctggtcctcaagtcagccacctctgtgtcttcctccatccaaaagacctgcaggagcttctgagcctggtgacacttgctggggaccaagaccatcctactccgccccagccacgctgcatgacctcatctcagcccaaaaacagacattgggaacatctgaccatccatcccgttcccccgctctttttggctacctgcagtgaccccagcagcaggggcgggagttgcctgccctcttccagcctggaagagcatctgtcctacgctcctccttccgggagtgactcccgcccgcatctcggggtgggaagggttcaggaaacacagaccagcttatcttaaggaagcctggtcgggaatctttcaaaaacacatctgttacaagggggaaagacacctccaggacaacagtgatttgcctcagcggggcaaaggccaggcctgacggaagagcccagccttcgccgagggccgcagggagccagagactcgagcctgcggttccagccccgccgcggttccggtcccgccgcgatcccgaggcctgcgcatgctcggtgctgcgcggggctccctccttaccgcaggagctcctcatcgagaaacccaggttggtgtcttttccacgtggtagaagctggctaacctccacttccacattccagcccaagggaaagtccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctct

SEQ ID NO: 293301 - DNA, 679 bp, Homo sapiens
aaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctct

SEQ ID NO: 293302 - DNA, 630 bp, Homo sapiens
cacaacatttccttgtatgtggatagcgtgaaagaagcttgtgatcctgcccccaccctccccaccgccacattttttaaagtgtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctct

SEQ ID NO: 293303 - DNA, 150 bp, Homo sapiens
actcctccccctactccaccggacctcaaccaggacttcagtggatttcagcttctagtggatgttgcactcaaacgggctgcagagatggagcttcaggcctctggagttgggcaggcctctggagttgggcaggcctctggagttggc

SEQ ID NO: 293304 - DNA, 1603 bp, Homo sapiens
cactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgcctttttttcatgacataataaagtattttcttta

SEQ ID NO: 293305 - DNA, 1928 bp, Homo sapiens
ttcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagt

SEQ ID NO: 293306 - DNA, 1743 bp, Homo sapiens
ttcccccccgccccacccccgccgacctcccactgtcgctgctggaggaagagccccgggaggagaagggtgcgccgcgccgcgcccgcgtgtcaatggcagccgcgcattctggaagaatttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagt

SEQ ID NO: 293307 - DNA, 1802 bp, Homo sapiens
ttcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgcctttttttcatgacataataaagtattttcttta

SEQ ID NO: 293308 - DNA, 1451 bp, Homo sapiens
acattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgcctttttttcatgacataataaagtattttcttta

SEQ ID NO: 293309 - DNA, 1438 bp, Homo sapiens
gcagtgggggtgcatctacgggagcggttgggctgtaagctttcgctacatcacagaattgtgccagtgtttctctttggagtgcctcgccagctttaataaccgtttggatatgacttgctcgggcaaaagttgtgcattggcccgatcaagcctgacttctagccaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgcctttttttcatgacataataaagtattttcttta

SEQ ID NO: 293310 - DNA, 1560 bp, Homo sapiens
ttcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtattgttgcagcatctggcagtgagactgaggatgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgcctttttttcatgacataataaagtattttcttta

SEQ ID NO: 293311 - DNA, 1816 bp, Homo sapiens
acattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtattgttgcagcatctggcagtgagactgaggatgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgatttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgcctttttttcatgacataataaagtattttcttta

SEQ ID NO: 293312 - DNA, 2212 bp, Homo sapiens
  misc_feature (2206)..(2207): n is a, c, g, or t
  misc_feature (2210)..(2212): n is a, c, g, or t
cgcggtccagagcgcggagcgcgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaagnnaannn

SEQ ID NO: 293313 - DNA, 1964 bp, Homo sapiens
cgcggtccagagcgcggagcgcgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccacccccaagactgggaggggacttctttttctaaaacacaaaactcagcccagccaggccccctccctggaggccagcccctccccgcagggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagattt

SEQ ID NO: 293314 - DNA, 2233 bp, Homo sapiens
  misc_feature (2227)..(2228): n is a, c, g, or t
  misc_feature (2231)..(2233): n is a, c, g, or t
cgcggtccagagcgcggagcgcgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaagnnaannn

SEQ ID NO: 293315 - DNA, 2182 bp, Homo sapiens
  misc_feature (2176)..(2177): n is a, c, g, or t
  misc_feature (2180)..(2182): n is a, c, g, or t
cgcggtccagagcgcggagcgcgcagcgcgggccggagggagggagggagggtgggcgaggggagaggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaagnnaannn

SEQ ID NO: 293316 - DNA, 450 bp, Homo sapiens
cgcaccgccccacgtcacgcccaccgctccctggcctctgattggccgaagctggcagagcagggcctctcgcgctcctgggtccatgcaacctgctccctgtggctgccgagttctcgggaacagcggctcggcctgcaaggctgttgtttcaagaaatgaaaatgaagggcgccctggaataggttcgccgaagagagaggttcgtgtctcagaaagtgtcgctgggaaaaaaaaatgcaattgaattcgccttggttgcgttttggttttcttaattttttgcatgattctttgctccactttccaaattcagcaacatggcctgtcgcggtggctcatgcctgtattcccagcactttgggaggccaaagcaggaagatcgcttgagcccaggagtttgagaccatcctggacaaggtagcaagaccccgtctttacagaaaactt

SEQ ID NO: 293317 - DNA, 415 bp, Homo sapiens
cgcaccgccccacgtcacgcccaccgctccctggcctctgattggccgaagctggcagagcagggcctctcgcgctcctgggtccatgcaacctgctccctgtggctgccgagttctcgggaacagcggctcggcctgcaaggctgttgtttcaagaaatgaaaatgaagggcgccctggaataggttcgccgaagagagagcaacatggcctgtcgcggtggctcatgcctgtattcccagcactttgggaggccaaagcaggaagatcgcttgagcccaggagtttgagaccatcctggacaagcttgcaggcctctgggaagcaagccatcgtgtggcagaggcccaggtggcaaggaaccaagggcggcttctggccaacagccagcgaggacctgagaccgtagcccaac

SEQ ID NO: 293318 - DNA, 1704 bp, Homo sapiens
cggggcgggcggcggctcctcggcggctccgcggcgcccgggccgcgcgccgccatgctgggcctggacgcgtgcgagctgggggcgcagctgctggagctgctccggctggcgctgtgcgcccgagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctggcctggcgctgtcccctgagctgtcccattaaacatggccctgtctctctcggtgccctgggtgtcgtctctttctgcctcccctcccctgggggccgggggcggccgcatgggccttgtctttgctgggactgggcctgtgtgccacgtggcagctgctgcttggcttctggcccccttatctgcccccgccccacgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctgtgagtgctggggccagtggggctggggaccggcgggggaccggcagagcccacctgggggccccaccctttgccggcaaatgcagggcatgtgcccaagaggggcctccccgcaggcacttgcccccactgtgcccaggagctctctaggaggggcctgggggtctggttggggcaggcaggagcagtgtggtagtactgggggtacccacaggacttgagaacacctgtgcctccctgctcggccagcggccacggtgccagagtcaccaccttgccggccactcctccagctgccaggggcatcccacagactctgcagaggctcgggcagtatccaggctttgggggcccatggaggtccctgacgtgtgtgccctgtggtcttttcgcaacccttgacacacataggaactgt

SEQ ID NO: 293319 - DNA, 2218 bp, Homo sapiens
gtgggcagggactcagaaacccctgcccagggcaccagggagaggggcttcaggaggccaccagcccggggcgccatgggaggcggcgcagagcctgagcccagggatttggagacagccgcccccggcacccgagcaccatggggaggaactcctagactgtgggaaagtgttcagagaccccagtccagagcagggtggtggagggccctagagggtcagtaggcttggggggccgccgagggccctagagggtcagtaggtttgggggccgccgagggccctagagggtcagtaggtttgggggccgccgagggccgctgctctctagcaggtagcccctgaccctgggctgccctcatctgaagtcttcgctcccccgccctttggtctccgagtcagggagggggcccttgtggacatctgggccagaggagctgcaggcctggcggtctctggaggcccctcctgaaggtctgggtgcggtgcggcacctccccaggccgccctgctctctctgctcgctctctccctgagcccccagaggcttcccttgagtccctttggatagtgggaggtacagctggccagagggggctccagcctggtgctcgaatgccagggtccgctagtggctgctgctcacgcccctccccacccccagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtgggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctggcctggcgctgtcccctgagctgtcccattaaacatggccctgtctctctcggtgccctgggtgtcgtctctttctgcctcccctcccctgggggccgggggcggccgcatgggccttgtctttgctgggactgggcctgtgtgccacgtggcagctgctgcttggcttctggcccccttatctgcccccgccccacgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctgtgagtgctggggccagtggggctggggaccggcgggggaccggcagagcccacctgggggccccaccctttgccggcaaatgcagggcatgtgcccaagaggggcctccccgcaggcacttgcccccactgtgcccaggagctctctaggaggggcctgggggtctggttggggcaggcaggagcagtgtggtagtactgggggtacccacaggacttgagaacacctgtgcctccctgctcggccagcggccacggtgccagagtcaccaccttgccggccactcctccagctgccaggggcatcccacagactctgcagaggctcgggcagtatccaggctttgggggcccatggaggtccctgacgtgtgtgccctgtggtcttttcgcaacccttgacacacataggaactgt

SEQ ID NO: 293320 - DNA, 1657 bp, Homo sapiens
cgcggcgccgaccccccggctggggtctggcaggggtgggggacttcatccaggctccagccctgtggggaagggaccagtcctcctggctgacaaggagggtgggccgccggcagtggacgaggtgttggatgaggctgtgcccgagtaccgggcgccggggaggaagagcctcttggagatccggcagctggacccggacgacaggagcctggccaagtacaagcgggtgctgctggggcccctgccaccggccgtggacccaagcctgcccaatgtgcaggtgaccaggctgacactcctgtcggaacaggctccggggcccgtcgtcatggatctcacaggggacctggctgttctgaaggaccaggtgtttgtcctgaaggaaggtgttgattacagagtgaagatctccttcaaggtccacagggagattgtcagcggcctcaagtgtctgcaccacacctaccgccggggcctgcgcgtggacaagaccgtctacatggtgggcagctatggcccgagcgcccaggagtatgagtttgtgactccggtggaggaagcgccgaggggtgcgctggtgcggggcccctatctggtggtgtccctcttcaccgacgatgacaggacgcaccacctgtcctgggagtggggtctctgcatctgccaggactggaaggactgaacccccagtccgtgtctcccctacctccctcagttgttgcacagggacccccaagcatccccagcaccccccgtgagtgaccagaccctcccctgctgcccctgctgcccctgctgcccctgctctgtcccgggaccccctggcctggcgctgtcccctgagctgtcccattaaacatggccctgtctctctcggtgccctgggtgtcgtctctttctgcctcccctcccctgggggccgggggcggccgcatgggccttgtctttgctgggactgggcctgtgtgccacgtggcagctgctgcttggcttctggcccccttatctgcccccgccccacgcgccctggcagcaccatgagccgccagcttctgcctgtactgctgctgctgctgctcagggcttcgtgcccatggggtcaggaacagggagcgaggagcccctcggaggagcctccagaggaggaaatccccaaggaggatgggatcttggtgctgagccgccacaccctgggcctggccctgcgggagcaccctgccctgctggtggaattctgtgagtgctggggccagtggggctggggaccggcgggggaccggcagagcccacctgggggccccaccctttgccggcaaatgcagggcatgtgcccaagaggggcctccccgcaggcacttgcccccactgtgcccaggagctctctaggaggggcctgggggtctggttggggcaggcaggagcagtgtggtagtactgggggtacccacaggacttgagaacacctgtgcctccctgctcggccagcggccacggtgccagagtcaccaccttgccggccactcctccagctgccaggggcatcccacagactctgcagaggctcgggcagtatccaggctttgggggcccatggaggtccctgacgtgtgtgccctgtggtcttttcgcaacccttgacacacataggaactgt

SEQ ID NO: 293321 - DNA, 986 bp, Homo sapiens
gaacttcttgctgacgccgccagcgccgaccaccagcagctgttttccctccatgaggcagcgcgccgaccgccgaagcatggtctccaccagcggcgccgccaccgcctcgtcggccgccggccccagccgcggcgcggcccacagcccctccagcgcgccgcacgcctccagacacaggccgccgttcagctccagggccactgggcttctccagcagcgccagcactgtgtccaccactgcacccagctctgcccgcgggtgcagacgccatgcctgccgcccccgccagcgccagccactgagcttcacagctacctgcagcaaggaggggaaaggggcctcctggacaccaccccagtgcagggctcgcggctggcaagaatgtacagctgacagagaacgagatccgcggtctgtgcctgaaatcccgggagatttttctgagaccagcccattcttctggagctggaggcacccctcaagatctgcggtgacactacacggccacgtactacgaaccttcctgccgactcattgagctatggccgcgcttccctcccgagagcaactacctctttctgggggactatgttggacaggggcaaagcagttccttggagaccatctgcctgcttgctggccctataagatcaaagtaccccggagaactctcttcctgctccgtgggaaccacgagtgtgccagaatcccgccgcgttctatgggttacgtacgcatgcagtgcaaagaagacgctaccaccattcacacctgctggcaacaacccgttcaactgacactgctttcaacttgcacttgcccaattcgcggaccattagctggacggataacgatccttcttggctgccaacggagggcctgctcccccgggaactgcagttctacatggagccaaactcagacaggacttcatgccggagcacatgacgcttcctacaccgtgcgcctgttgtgttacccg

SEQ ID NO: 293322 - DNA, 1991 bp, Homo sapiens
ggccttaccaatcgcgaaaacccgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293323 - DNA, 2019 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293324 - DNA, 3019 bp, Homo sapiens
  misc_feature (1)..(2): n is a, c, g, or t
nngagcaaattcattcccttgctgggttgctgggctctggcactgcgctggccctcgttggaggtctgcagaagtgcacagaaagtgtgggcaatggactggccatttccacagttttggaaacttttaaaaatccatattcttgctgggattacagatgtgagccatcgtgcccagcccacccactttgttaatcatgatcagagcaggggtgccattctaccaccttggcacacctgcctagaggagtgagtggcgctgggagcagactgaggaacatcttagctgagcagtgaatccagcactgttctaaggaagctcagatggtctgtgactcatccctgtcctctggactgaatctgaggccttggaactcacccagggtcttagtggaggtacagctctgagctatgggtgtagagcatctgaacccatctacacattgaccaaacacaggcaggttccagtctgcgggggagatggagaaggtgccaccatgctgctgcacaaatcccaggatagctggggaatgagaatccagcactttgggcctaggacctggaaggagaggtcttttgggagaggtatggggacatctgaaggaggacttcttggaaggggaggggctggagcagaggcaagagtgattttgtcagatggagagaaggttctccacatgggcggggctggcagaggcagatgcccagacaggtcacaactctctgtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcagtgggtgcctggatgagggaggagtggggaagtgttccctgaggggacgggcctgcccctaccacattcggaccttcctacttcgtggtgtgggcactccctgcaatgtggctcccaatcctctttccctccagccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgcaaatggggatagaatgaggagtcgcatctaggcggcagtgagttaggaacagtgtcagaggactggtctgtcataattccagcgccccacccatgtacatgggtttcttttcccccacagtatttggaggtggggttggtgggtgactccatgtaactttcatactccatccccctgaagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293325 - DNA, 2104 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293326 - DNA, 1844 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293327 - DNA, 1751 bp, Homo sapiens
  misc_feature (1)..(1): n is a, c, g, or t
ntcggacccacgcgtccgggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293328 - DNA, 1761 bp, Homo sapiens
ggccttaccaatcgcgaaaacccgccgttcgcgctctgaccagcccgcagagccagcccccgaccccgggccacctgggcccccgggttccgccggcactctcgccaccaccgcgtgggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293329 - DNA, 1808 bp, Homo sapiens
ggccttaccaatcgcgaaaacccgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293330 - DNA, 2347 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatgtaactattcgaccctttccttgccccggtccgccggcgctgctgggaaggcttcctagtctctctgcccgcacttcccgcccagaccacgtgcggagcctgagggccctcttggaaggtatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggactgaagcttcaataggagttccaggcattaagatggatggtggagatgcacaagaacatggtcatttccttagactaccccaggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293331 - DNA, 2230 bp, Homo sapiens
tagcatgatacgatcgagctcgtaccccggaatatgaaaagagcctgacttcctgatgaataagcgattaaggattttaggtcggtttgacgtaagcagatagagctggttatgattatacctcatatggaaagcatgaggaatggataggctatgtagtttgttagtgggtttagaatagtagtgattcgcattatgccatagcttcctcatccttcctcagttctctttctgctacttattccctcaactctgcatcaggcagccctcatccagcatcacgtgcacaggctgtgggctccttgaagcacctctcaagccatccacgccagcgtctctctgcagcaacacagccctgggctcccaaggggtgcagactgtgttgggaagtagagaaccatcccatgctcttggataccctttctgctctggcttttccttatactctgaggagccatctctggaaaaggccccactttcccagacccaggtgtcctaccaggccccaagttgtatccctcgtgctgcttaggccacgccctgcaggatgttctctgcggcctcccagcctttggaccccgatgggaccttgttccggcttcgcttcacagccatggtctggtgggccatcacttttcctgtgttcggcttcttcttctgcatcatctggtccctggtgttccactttgagtacacggtggccactgactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293332 - DNA, 2099 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293333 - DNA, 1766 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtgggccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293334 - DNA, 2070 bp, Homo sapiens
ggccttaccaatcgcgaaaacccgccgttcgcgctctgaccagcccgcagagccagcccccgaccccgggccacctgggcccccgggttccgccggcactctcgccaccaccgcgtgggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggcaggttccagtctgcgggggagatggagaaggtgccaccatgctgctgcacaaatcccaggatagctggggaatgagaatccagcactttgggcctaggacctggaaggagaggtcttttgggagaggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcagtgggtgcctggatgagggaggagtggggaagtgttccctgaggggacgggcctgcccctaccacattcggaccttcctacttcgtggtgtgggcactccctgcaatgtggctcccaatcctctttccctccagccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293335 - DNA, 1323 bp, Homo sapiens
  misc_feature (1)..(1): n is a, c, g, or t
ntcggacccacgcgtccgggacggccccagaatggcatggtagatggaacgcagctgagagccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293336 - DNA, 2408 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatgatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtgggccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgcaaatggggatagaatgaggagtcgcatctaggcggcagtgagttaggaacagtgtcagaggactggtctgtcataattccagcgccccacccatgtacatgggtttcttttcccccacagtatttggaggtggggttggtgggtgactccatgtaactttcatactccatccccctgaagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293337 - DNA, 2661 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatgatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgcaaatggggatagaatgaggagtcgcatctaggcggcagtgagttaggaacagtgtcagaggactggtctgtcataattccagcgccccacccatgtacatgggtttcttttcccccacagtatttggaggtggggttggtgggtgactccatgtaactttcatactccatccccctgaagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293338 - DNA, 2279 bp, Homo sapiens
ggccttaccaatcgcgaaaacccgccgttcgcgctctgaccagcccgcagagccagcccccgaccccgggccacctgggcccccgggttccgccggcactctcgccaccaccgcgtgggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaatggtgaggtgggaactgagttctaatgggaaccctggcagaggggtgctggggttggggctggggcttgggaacaaactgagggtggttggtcagaatctaggactatagcactgtgtttgggtagtgtgggagactggagaatagaagagatggaggctgcaaatggggatagaatgaggagtcgcatctaggcggcagtgagttaggaacagtgtcagaggactggtctgtcataattccagcgccccacccatgtacatgggtttcttttcccccacagtatttggaggtggggttggtgggtgactccatgtaactttcatactccatccccctgaagtggaagcggcaggaataccactgctcctcggcccatcactcccccagaggcagggacgtgaacacatagtcgtcattcttgctgcccctgcctgtgctcccttccatgaccgctagtgggagccaagggagataaggcccagcccttaggagttagggctgagaggggagcccacgctctcatacccagcaagctgcagagtgatcagacagcccattccctaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293339 - DNA, 1902 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293340 - DNA, 1367 bp, Homo sapiens
cacgaggatggaacgcagctgagagccatccacgaaaatgctttcattgtgttcattgcctcatccctcgggcacatgctcctcacctgcattctctggcggttgaccaagaagcacacagtaagtcaggaggaggtacggtctatccctagcgggggctccaaggcagcccagaagaaaatcaaggacatctgtcctcaggattcgggtaagatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctag

SEQ ID NO: 293341 - DNA, 1982 bp, Homo sapiens
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctacttgctccaaaccctaaattttggttgtacattttatttgaaaggaaaataaattttttttttgggccaacagttgcctaggcttgctag

SEQ ID NO: 293342 - DNA, 1673 bp, Homo sapiens
  misc_feature (1414)..(1414): n is a, c, g, or t
  misc_feature (1416)..(1416): n is a, c, g, or t
  misc_feature (1425)..(1426): n is a, c, g, or t
  misc_feature (1440)..(1441): n is a, c, g, or t
  misc_feature (1466)..(1466): n is a, c, g, or t
  misc_feature (1471)..(1471): n is a, c, g, or t
  misc_feature (1529)..(1529): n is a, c, g, or t
  misc_feature (1574)..(1574): n is a, c, g, or t
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaaaaatgaggggtgggggcaactcaccactgccangnaactccctnnagggtgggagtggnntatcttctaggctcttacccgcggnagggnagggcattaacaattgcttcctttcattctcctttcccccaatccaattaagtgctgncacagggcagaagcacacaaaccaaccacacaagtttttgacttnctctcagcacctttgagttggttaaatggggctcacggggcaagaagttttgctggccttccccagcgtggtcacaaggttaattggactgccttgcct

SEQ ID NO: 293343 - DNA, 1591 bp, Homo sapiens
  misc_feature (1414)..(1414): n is a, c, g, or t
  misc_feature (1416)..(1416): n is a, c, g, or t
  misc_feature (1425)..(1426): n is a, c, g, or t
  misc_feature (1440)..(1441): n is a, c, g, or t
  misc_feature (1466)..(1466): n is a, c, g, or t
  misc_feature (1471)..(1471): n is a, c, g, or t
  misc_feature (1566)..(1566): n is a, c, g, or t
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtgcccaattacctgccctcggtgagctcagccatcggcggggaggtgccccagcgctacgtgtggcgtttctgcatcggcctgcactcggcgcctcgcttcttggtggccttcgcctactggaaccactacctcagctgcacctccccgtgttcctgctatcgcccgctctgccgcctcaacttcggcctcaatgtcgtggagaacctcgcgttgctagtgctcacttatgtctcctcctccgaggacttcaccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaaaaatgaggggtgggggcaactcaccactgccangnaactccctnnagggtgggagtggnntatcttctaggctcttacccgcggnagggnagggcattaacacctgtcttcctcccattctctttccccaatccattattgctgcacagggcataacccacaaaccaacacacagtcttgcttcntctaacactttagtggtgatggggc

SEQ ID NO: 293344 - DNA, 1420 bp, Homo sapiens
  misc_feature (1161)..(1161): n is a, c, g, or t
  misc_feature (1163)..(1163): n is a, c, g, or t
  misc_feature (1172)..(1173): n is a, c, g, or t
  misc_feature (1187)..(1188): n is a, c, g, or t
  misc_feature (1213)..(1213): n is a, c, g, or t
  misc_feature (1218)..(1218): n is a, c, g, or t
  misc_feature (1276)..(1276): n is a, c, g, or t
  misc_feature (1321)..(1321): n is a, c, g, or t
aaaccgaactgaagggggaaggggcgagagggaagaggaggggcagaaggagttcggggaggcacagggtaggagcggtgagagggccgtggagtcccgcccctcgccgccgcggttggcgggagcgtgtcgtgacgtcacacagggcctctcgaagtgggcttgtgaatggctagattgggaagcaccggcggggtgtcgggaagggtggtgacgcaacatagagactccgcccccttccttggagcggcgcgactcgggctgagggagctcgggccaatcagagggacggccccagaatggcatggtagatggaacgcagctgagaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtgggccatccacgaaaatgctttcattgtgttcattgcctcatccctcgggcacatgctcctcacctgcattctctggcggttgaccaagaagcacacagtaagtcaggaggatcgcaagtcctacagctggaaacagcggctcttcatcatcaacttcatctccttcttctcggcgctggctgtctactttcggcacaacatgtattgtgaggctggagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgcttgggaggacgcagcccactgcccagaaacaagaaacacgataccattctggccttccccaccccacatcctctcttggccttactgaagatgggggaagggtaagaaggaagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaaaaaatgaggggtgggggcaactcaccactgccangnaactccctnnagggtgggagtggnntatcttctaggctcttacccgcggnagggnagggcattaacaattgcttcctttcattctcctttcccccaatccaattaagtgctgncacagggcagaagcacacaaaccaaccacacaagtttttgacttnctctcagcacctttgagttggttaaatggggctcacggggcaagaagttttgctggccttccccagcgtggtcacaaggttaattggactgccttgcct

SEQ ID NO: 293345 - DNA, 346 bp, Homo sapiens
tgaggccaggataggatccacaggcggtcatgagtggctgcggggcagcaatgatgtttttgataatgggcaatggtcttggggactggctgccattgtgttctctgtggcagaccaatggtggtgtgatttatcaagaggcctctgagcgggtagctggaagttcaccatgtcctgttccttgtgtcctcacaacagtgtacaccatctttgccatcctggagtacactgttgtcttaaccaacatggcgttccacatgacggcctggtgggacttcgggaacaaggagctgctcataacctctcagcctgaggaaaagcgattctgaacccttcagtcctgctt

SEQ ID NO: 293346 - DNA, 274 bp, Homo sapiens
gctctagtggatccggctgatgttaagagagcctctcccatctttggcttccgtgtccccatctaaacccttgtacagtcatcccccatcctttcacctctcaaacaagcaagacaccagtccctgcagctgtgtattatcttctcctttttccttaaggactgaagcttcaataggagttccaggcattaagatggatggtggagatgcacaagaacatggtcatttccttagactaccccaggttaggagcacccactttcttttttctttt

SEQ ID NO: 293347 - DNA, 955 bp, Homo sapiens
gttccggctctgtcttgagattttctttgtaacttctctgtgcctcagttatttgggggtactttaattggctcagtagagaaaaagcatagagtatcgtggctaagaaggtagaccacctggagccagaatccctccctggttcagatctcgattctgcgtcttactagctgtatggcctccatttctgcatctgtacaatggggagagtaatagttcctacatctcaggatcgttgtgaggcataaatgcaatcgtggtccaggaccacgattttgtacactctgaagccctagtcagctctctctgactccccacagcaactcactttacgctgaaggagacgggctcagagagatgaggggctcacctgtggccatagcagtgctctacatcccagccctccatcccttcaacaactccccaccacttcccagtctgccagagagcaagccgtgtgcccgtcatttcctcctggcactaaaggcgtatgccccaccgaggccgaacacaacctcgcagggagaaatgcatttgcacggtgccgggcaggcttttcttagctcctggtatagcttgaacaggcgtctgcagagtgttctcagaggcaggaagaatgatgccagtaacagtgattagaaactcgaggcagtgtaggattctgacacatcgatggtaagatgactgaggcaacaaacgcaggagatggtgtgacaccggacacccacatttcagactcacagtctccaaatattcgcataactccatgttgagttcagattttcaggctaggaaaatacattttcctgttctgaattgttccaaccctaaccaaaatgtcatctctgaagaagctagggttgcctgttttacttctgtgggatctgtgttttcaggaagcaatcagttcctatagtaagtaactttgtggaactcaattacttgcagacgtgca

SEQ ID NO: 293348 - DNA, 1158 bp, Homo sapiens
ccgggtcactgttaagggggccgccatggcccggctgtggggcgcgctgagtctttggccactgtgggcggccgtgccgtggggcggggcggcagccgtcggtgtccgggcttgcagctccacggccgccccggacggcgtcgagggcccggcgctgcggcgctcctattggcgccacctgaggcgtctggtgctgggtcctcccgaaccgccgttctcgcacgtgtgccaagtcggggacccggtgctgcgcggcgtggcggccccggtggagcgggcgcagctaggcgggcccgagctgcagcggctgacgcaacggctggtccaggtgatgcggcggcggcgctgcgtgggcctaagcgcgccgcagctgggggtgccgcggcaggtgctggcgctggagctccccgaggcgctgtgtcgggagtgcccgccccgccagcgcgcgctccgccaaatggagcccttccccctgcgcgtgttcgtgaaccccagcctgcgagtgcttgacagccgcctggtcacctttcccgagggctgcgagagcgtcgccggcttcctggcctgcgtgccccgcttccaggcggtgcagatctcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293349 - DNA, 661 bp, Homo sapiens
  misc_feature (12)..(12): n is a, c, g, or t
  misc_feature (83)..(83): n is a, c, g, or t
  misc_feature (96)..(96): n is a, c, g, or t
ggggaaagaggncccaacctccccccacccacccccaccccacacccacccccaaccccccaccctccccccctacccacccncccctccctccanaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293350 - DNA, 2481 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293351 - DNA, 2632 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggtgcgacgcgcctggcgctaaaggggttttataactgtaaaagctgacatttacgatggtagaaataactaacacataaagcgtttaccacgttccaggttctctgctgagcgctttattaatccatttaaacctcacaacagccttcgaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293352 - DNA, 2029 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293353 - DNA, 2417 bp, Homo sapiens
cacaaagaaaaaggattcatgcaaagctcttattatcgggtctgacacagttaacattataggtgtgagctgaatatatgtgcacatttatatacttattttatacgaaagcgtggaccggaggtcatctgcttcaaaacttccattgacgggaaggtgacaaggaaatcctcgcatttgagggcatcagatatcaaaaagtctctccatttggatggctggatgtggtggctcagcctgtaatcccagcactttgggagcctgaggcttgaacccaggagttcgagagcagcctggccaacatggcaaaaccctgtctctataaaataaaaaattagctggtcgtggtggcgtgcgcctgtagtcccaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggcattcctcccactcagctctccaagtacggtaacctagggcatgtgaacatcggcgccattcaggagcccctcgcctttatcctgccaaagagagagacgcttttcaccctggatgaccaggcgctggggcccgagctcacagctccagcaccagagcctcccgccgaggagccacgcctggagcccgcgggcccagcctgcccggagggagggcgagcggagacgcaggccgaaccgcccagcgtggggccctagccggcgtcccctgcctccagaacgcgggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293354 - DNA, 1714 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggtaagagaatgaaaattctgtaaactgccttactgatgtgtaattcacatactaaataattcatccatttgtgta

SEQ ID NO: 293355 - DNA, 1754 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggtaagagaatgaaaattctgtaaactgccttactgatgtgtaattcacatactaaataattcatccatttgtgtaagtcagtgttttttagtaaatatgaatccaattttagaat

SEQ ID NO: 293356 - DNA, 2285 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaattcaggaaacagtggagaaattccaggaagaaatgaactcctacatgctcatctcggctccagccatcctgggcaccagtaacatgcctgctgctgtgccagccacccagccggggacgctgcagccacccatggtgctcctagatttcccacccctcgcctgctttctcaacaatattctggttgccttcaatgatctgcgcctctgctgccctgtggccctggcgcaggatgtgactggggccttggaagatgcccttgccaaggtgagcacattctgttggttttctgctaccctgggccttctctggtaatgggtggccagatttttgtaataaacccgtctatttgacggtgtctgctgacatggagaggtctagtgtggttttggaggttctcctgattgagaagctctggccagttgcccttcatgggacctaggacagtccatgaagtgatttgcctatagtaacaattcggtaatacacgtattagctttctagtgctgcataacaaatttccacaaacttagtagcttccagcaacacatttattaccttccagttttggtgggtcaggagtccaggcacagcacaaccgggtcctctctgctcagggtcttacagggttgccatcaaggtgttggctggactatggcctcatctggaggttggggctccatttcagactcatgcaagttggcaggggtcagttctttgcaattgcagaactgaagcctcagctcctagaggctgtccactccataggcagctgacaacatggctgtttgcttcctcaaggccagcaggagagctactctcttgagtctcttcttttaggtacctccttttaaaaacttcatttgattaagtcagatgattagggactttaattacatctacaaaaccctttacctttagcatattcttttatttttattgttaaaagtgttttattttacagagagatagtgtctccctatgttgcctaggctggtctcaaactcctggactcaagtgatcctcctgctacagaccctcaaagtgtgggattacaggtgtgagtcacttgaacttgggaa

SEQ ID NO: 293357 - DNA, 1538 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcactgaggctgagttgagggtgaagtttcttcaggcccgagatgcttggctccggtccatcctgactgccattcctaatgatgatccctatttccatattacaaaaaccatcgaggcctcccgtgtccatctctttgatatcatcacccagtaccgtgccatcttctcagacgaggacccactgctgccccctgccatgggtgagcacactgtgaatgagagtgccatcttccatggctgggtgctacagaaggtctcacaattcctgcaggtgctggagaccgacctttaccggggcataggcggccacctggactctctgctgggccagtgcatgtactttgggctgtccttcagccgggtgggagctgatttccggggtcagttggctcctgttttccagcgggtggccatcagcactttccagaaagcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggc

SEQ ID NO: 293358 - DNA, 1199 bp, Homo sapiens
agttcggagtcagcgccccttgtggtccggaagggaagtgacgttgttgctgggaagatggcgaccgcggcgactatcccatcggtagccacggccacagcagcggctctcggcgaggtggaggatgaagggctcctggcgtcgctgttccgggaccgcttccccgaggcccagtggcgcgagcggcccgatgtgggccgctacctccgggagttgagcggctcggggctggagcggctgcggcgcgagcccgagcgcctggcggaggagcgggcgcagctgctgcagcagacgcgcgacttggccttcgctaactacaagaccttcatccgcggcgccgagtgcaccgagcgcatccaccgcctgtttggcgacgtggaggcgtcgctcggccgcctgctcgaccgtttgcccagcttccagcagagctgcaggaactttgtgaaggaagccgaggagatcagctccaaccgccggatgaatagcctgaccctaaaccggcacacagaaattttggaaatactggagattcctcagctcatggacacctgtgtccggaacagttattatgaagaggccctggagcttgcagcctacgtacgccgactggagaggaaatactcttccatccctgtcatccagggcatcgtgaacgaagtgcgccagtccatgcagctgatgctgagccagctgatccagcaactgaggaccaacatccagcttcctgcctgcctccgtgtcattggctacctgcggcgcatggacgtcttcaccattgcccaagtgaagcagcttttaactctcttgcccaaagtcctctgagaatttcttcactttcaggaggtcgtctgcattcaccgtgggccgggtggtggccagagaccgcagcatgtccgactgtgaaggcaacagtatgtgcctgagcaggagccaggctccaggtccccaacctcccctcagcacacaacaggcgcagctgagggtgggaagaggtttgccttcaaggccaccccagaggcctgcttgaatctgcctatggcagggaccctcttccctctcgaggcagctcagatgggcctcctcctggtctgagaatctaagctccatcatctcataactccccttacgaacttgctttcttttttttttttttttttttggggagacggagtctgtcacccaggctggagtgcagtggc

SEQ ID NO: 293359 - DNA, 878 bp, Homo sapiens
gaggaggagccaagatggccgaataggaacagctccggtctacagctcccagcgtgagcgacgcagaagacgggtgatgtctgcatttccatctgagcttctgccatgaccggaagcttcctgaggcctccctagaagctgagcagatgccagcactgtgcttcctgtacagcctgcagaactggcacctctggtgggattccctccccttctggatgggtgcaggctgtaccacttgtcccttggatttgcaattccaggaggaaaataatgagccagcattgtgggaaaatgtcactctgccccagtgatcagtctctaagactggggagggaagtcaagcttgaaacggcagagtggattttctcttcaaggagcacttttaaagaaaacaaaggcttctgtgatcaatattttatgtcaaacatcctgtgaggatgaagggcccttctatgcttcaccattttaacctctcatttggaaaagcaaaaaggcctgggagaagctgcgttcgcaaaatctctcctggatgacttgttcagaagccagttcagtaaattcaaactgttccagagtccccttttgaaaaccacagatgccgtggacccactaaggttgagacgcagtgtttgtcccctccaggagacacagtgttcaaggcgccatcttggaagcagagaccaagcccttgccatactaaacaggctagcactgtgatcttggacttgtcagcctccacaatggctcacagttagactacattcctagcctcctgaagagttaggtacagctgtgtgactgaattcctgccaatgaaatgtggtgagaaccacttccaggcctggcccacagaaacctcccatagacaattcttcatc

SEQ ID NO: 293360 - DNA, 1131 bp, Homo sapiens
tcgcagaaggctttttattcattattattaatgtcctttgaaaaaagaccctttaattaatgttcctattgggcacagagctttttaaagacaccactccctccctaacacacacagctgtgttttatagactaattgtcacctaaccaagggaccccacagggatctgcaatttgtcccacctctgccctgccacacttccctgcaacgctcctaattgctgaatcccattcagcctcatgaaagtggtggccgatatttaaagttcatttcaggaaggcttcataataactggggaaaataacataatctcgttttaaaacatttccttcctctgttctgctgatagaatcaaacaatccagagttccatctgtcctgtcacaggtccagattttaggatgtggttttgaagttacttgttttctttgtttcagggcacctctggtgggattccctccccttctggatgggtgcaggctgtaccacttgtcccttggatttgcaattccaggaggaaaataatgagccagcattgtgggaaaatgtcactctgccccagtgatcagtctctaagactggggagggaagtcaagcttgaaacggcagagtggattttctcttcaaggagcacttttaaagaaaacaaaggcttctgtgatcaatattttatgtcaaacatcctgtgaggatgaagggcccttctatgcttcaccattttaacctctcatttggaaaagcaaaaaggcctgggagaagctgcgttcgcaaaatctctcctggatgacttgttcagaagccagttcagtaaattcaaactgttccagagtccccttttgaaaaccacagatgccgtggacccactaaggttgagacgcagtgtttgtcccctccaggagacacagtgttcaaggcgccatcttggaagcagagaccaagcccttgccatactaaacaggctagcactgtgatcttggacttgtcagcctccacaatggctcacagttagactacattcctagcctcctgaagagttaggtacagctgtgtgactgaattcctgccaatgaaatgtggtgagaaccacttccaggcctggcccacagaaacctcccatagacaattcttcatc

SEQ ID NO: 293361 - DNA, 331 bp, Homo sapiens
tctggtgggattccctccccttctggatgggtgcaggctgtaccacttgtcccttggatttgcaattccaggaggaaaataatgagccagcattgtgggaaaatgtcactctgccccagtgatcagtctctaagactggggagggaagtcaagcttgaaacggcagagtggattttctcttcaaggagcacttttaaaggtaatagaggccaggtgcagtggttcatgcctgtaattccagcactttgggaggccgaggcaggtggatcacttgaggtcaggagttcgagaccagcctgaccaacatggcgaaaccccatctctactaaaa

SEQ ID NO: 293362 - DNA, 939 bp, Homo sapiens
cgtcaatgcgacgtcctcctactcccacctcagagctgtcacagagactgtcagttccgtccctccccttcagccctttaacgcacgtcttcccgaccgcataacttgctcagtccctgcggccaactggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgcttggtggcatgcatgtttagtcccagctacacagcagggaggctgaggctgaaggaatacttgagcccaggaattcaagactagcctgcacaacatagtgagaccctgactttaaaataaatttaaaaaaattaaaagcaacaagactttctgcttgtatatgatgatgttagtatgctgacttacaaggttagatcattttgatatgtgtgatgtaggttttcaaagctggcactgttttatgcttcaaatattatttttattcattggttctcatgggatttcatcactaagctgtaaatcaataatcataatgttgaggggaggggattacaaaatagctcttcaaaatcatctttgcatttctcaataaacagcattcccttttggactacagtgaaaaatattgagctttgtttactttgaaaatgagtcttagtctatgaatgcctgggtagggtcaagaatgaaaaatgagaggaagagagaagcatcaggaagataaaatgatcaatctcacaaaa

SEQ ID NO: 293363 - DNA, 1026 bp, Homo sapiens
cgtcaatgcgacgtcctcctactcccacctcagagctgtcacagagactgtcagttccgtccctccccttcagccctttaacgcacgtcttcccgaccgcataacttgctcagtccctgcggccaactggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagcttggtggcatgcatgtttagtcccagctacacagcagggaggctgaggctgaaggaatacttgagcccaggaattcaagactagcctgcacaacatagtgagaccctgactttaaaataaatttaaaaaaattaaaagcaacaagactttctgcttgtatatgatgatgttagtatgctgacttacaaggttagatcattttgatatgtgtgatgtaggttttcaaagctggcactgttttatgcttcaaatattatttttattcattggttctcatgggatttcatcactaagctgtaaatcaataatcataatgttgaggggaggggattacaaaatagctcttcaaaatcatctttgcatttctcaataaacagcattcccttttggactacagtgaaaaatattgagctttgtttactttgaaaatgagtcttagtctatgaatgcctgggtagggtcaagaatgaaaaatgagaggaagagagaagcatcaggaagataaaatgatcaatctcacaaaa

SEQ ID NO: 293364 - DNA, 1029 bp, Homo sapiens
agctgccgggatcccagccggaaggggcgggcgaaaggcagggttgctgggggcgggcgaaaggcagggttgctggaggcgcgcgtaggttcgagtagggactggaatgcgggccaacagtgtgggggttattaggggggagggtaggcaggtcggaggagggagttgggaggaaagcggcggcggtggcggcttcaacagcagctcttgcccttaaggaacaatgaaacacaaagatggtgcagacccaggccctgctttgactgggagaaagatgcattcagttgactaaaacttgaaagggcagtttacttctatagaagggtgcaccctcacagatggaccaatgtgtcaggagaattcagtcacacccaaagcaggaggtaataagacaccgaagtgaggacttcacaggctgcttgggagaagacaatcatccgtgggcttgggaaagggagaaatgcctactgagtttagggaattgcttgctggaagaaatgatggcttggtggcatgcatgtttagtcccagctacacagcagggaggctgaggctgaaggaatacttgagcccaggaattcaagactagcctgcacaacatagtgagaccctgactttaaaataaatttaaaaaaattaaaagcaacaagactttctgcttgtatatgatgatgttagtatgctgacttacaaggttagatcattttgatatgtgtgatgtaggttttcaaagctggcactgttttatgcttcaaatattatttttattcattggttctcatgggatttcatcactaagctgtaaatcaataatcataatgttgaggggaggggattacaaaatagctcttcaaaatcatctttgcatttctcaataaacagcattcccttttggactacagtgaaaaatattgagctttgtttactttgaaaatgagtcttagtctatgaatgcctgggtagggtcaagaatgaaaaatgagaggaagagagaagcatcaggaagataaaatgatcaatctcacaaaa

SEQ ID NO: 293365 - DNA, 1069 bp, Homo sapiens
cgtcaatgcgacgtcctcctactcccacctcagagctgtcacagagactgtcagttccgtccctccccttcagccctttaacgcacgtcttcccgaccgcataacttgctcagtccctgcggccaactggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagtttgtgatgaagaaataaacaatgcccagttcctgccctggagaagctcattgcatagaaaaaggaaaaaggcagatatacatgccacagtacagtgctgagacaacataaatcacaagcaaccaagtacaaagtgaattatacagaatctggttttcttctgtttggatttgatactgagctatactggattcactgacaagaagagtttgaattagcagcatgctgagaatggacacagtgtttgaagagactgataaagaaagtacaggaggagttttatttttggaagaagaaatggtccttgggcacagaccccatatgagttttcctttcagcgttctctgctcagctgttctctgctgtggtgaggcgcctatgctttgtatatgtctgaaattaattgaaaagctagtgacagattctgatgtcatttgccatgagctttattattgtgcaggtaattttggatcaaatcaccctaacgtttttcaacaaagactttagaagaaataaagctgcattactttttcttggcgcattcttcctttaggacctatagtgaggt

SEQ ID NO: 293366 - DNA, 1071 bp, Homo sapiens
cgtcaatgcgacgtcctcctactcccacctcagagctgtcacagagactgtcagttccgtccctccccttcagccctttaacgcacgtcttcccgaccgcataacttgctcagtccctgcggccaactggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagaaacacaaagatggtgcagacccaggccctgctttgactgggagaaagatgcattcagttgactaaaacttgaacggtcggctccaccagtgcaaggattgtgcctgtcctcttcccgggctgatcttcccctgtgcctggaacagcacctgctatataaattatgtgctggatacacacactcgaaaagcaagagatcaggctccctgagaaaagggcagtttacttctatagaagggtgcaccctcacagatggaccaatgtgtcaggagaattcagtcacacccaaagcaggagatgcgggaggccagatgcgcaagatggacactcggctcctccttcgtccccgcctctcctcgcttccagggtagcagcctcaacaagggaaactattgttccagtggaggctgcgaggatgtcggtgatttacgcgccgagctgtagctgcaaaaggacaagggcaagtgccggcccgacctagggcccaccggtctctggcttgctcttgtgagtaggtgcaccctgcccgcttgtggtggcctcaggggtaagaaatcaggacccacccag

SEQ ID NO: 293367 - DNA, 803 bp, Homo sapiens
cgtcaatgcgacgtcctcctactcccacctcagagctgtcacagagactgtcagttccgtccctccccttcagccctttaacgcacgtcttcccgaccgcataacttgctcagtccctgcggccaactggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggcttggtggcatgcatgtttagtcccagctacacagcagggaggctgaggctgaaggaatacttgagcccaggaattcaagactagcctgcacaacatagtgagaccctgactttaaaataaatttaaaaaaattaaaagcaacaagactttctgcttgtatatgatgatgttagtatgctgacttacaaggttagatcattttgatatgtgtgatgtaggttttcaaagctggcactgttttatgcttcaaatattatttttattcattggttctcatgggatttcatcactaagctgtaaatcaataatcataatgttgaggggaggggattacaaaatagctcttcaaaatcatctttgcatttctcaataaacagcattcccttttggactacagtgaaaaatattgagctttgtttactttgaaaatgagtcttagtctatgaatgcctgggtagggtcaagaatgaaaaatgagaggaagagagaagcatcaggaagataaaatgatcaatctcacaaaa

SEQ ID NO: 293368 - DNA, 462 bp, Homo sapiens
atcccataaatggagtctgggacagaaacctacacattggggcttggtggcatgcatgtttagtcccagctacacagcagggaggctgaggctgaaggaatacttgagcccaggaattcaagactagcctgcacaacataagcctcctctgtcacctgggctggagtgcgatggtgtcatcttgggtcactgcagcttctgcctcttaggttcaagtgattctcatgcctcagcttcccaagtagctgggattacaggcatgcgccaccaggcccagcaaagttttgtatttatagtagaaatggggtttcactgtgttagccaggttgttctcaaactcctcacctcaggtgatcacctgcctctgcctcccaaagtgctgggattaaaggaatgagccactgggtcgggcaaacacagagataaattgaaagcatatttaaatgtttcctgtttcatcag

SEQ ID NO: 293369 - DNA, 1112 bp, Homo sapiens
cgtcaatgcgacgtcctcctactcccacctcagagctgtcacagagactgtcagttccgtccctccccttcagccctttaacgcacgtcttcccgaccgcataacttgctcagtccctgcggccaactggggcgggccaatggctgtgacggataaggggtgtggggtgcggggacaatgggccagagcttctcatgcagcctgcaccagcgccgggtcggagagtcagaggccaccctgagatggaccgagatcttcagttggggaggcgcctccggtgagcttgcggccagatgccccctcagtagtcctccgcaacaggtgccgcgcagccgagtggcgggctagcataccgcctgcccgcaattcggccaggcctcgagcctgctccgccttcccgctgcggtagcgccgccggggaaacgccgccacgggctgcatgggcagcgctcgcgccccgccgctgagccgccggggagccgtccagtcttcgaatcccagaaacacaaagatggtgcagacccaggccctgctttgactgggagaaagatgcattcagttgactaaaacttgaaccacagcatgttccgaagagatgattggaagatggaagtggagggttaaataatgaaatgcagctaacatttcggaaagtttctaaaagttgtacaacatgccctacagctactctttaaatctccaaatcaaatgagaaatgcaacaacttgagcaagagtgatcagttactaagaggagtacctaacgtccttagaagaaaagattcagatcatagggattttatttacagaaatgtatttacctgtttgtaatgtatgccagtttagatggagtctagctctgtgtccaggctggagtgcagggacaagatctcggctcactgcaacctccacctcctgtgttcaagtgattccacaggcttagcctccctagaagctgggactacagtctcgttctgtcacccgggctggagtgcaggaggacaatctcggctcgctgaaacctctgccgcctgggttcaagcaattctctgggtcagcgtcctgcgtagctgggattacaagcgcctgccaccacagttggctaatgtttaa

SEQ ID NO: 293370 - DNA, 343 bp, Homo sapiens
ttatatttgagtgctgtttcttttgcggcacaaaactttataacaatttggggggctcacctgtaattacattcctctcagggcccaccggtctctggcttgctcttgtgagtaggtgcaccctgcccgcttgtggtggcctcaggggtaagaaatcaggacccacccagtgagagaaataacccaagctgtcagcaacgcggaaagaaatgggctagcaacctcttaaagcatcctcacgtactgcggcgatgactctgtgcacagaccaaggaaggagagaggccgcggaagtcaggtaaagtacttccttggtggtcagattctggagggctaaacgtgt

SEQ ID NO: 293371 - DNA, 1893 bp, Homo sapiens
gcacctcctacgacactgccgaatggaaaaagtgagggcagcgtacgcctggtagggggcgcgaacctgtgtcagggccgagtggagatcctgcacagtggcctgtggggcaccgtgtgtgacgacgactgggggctgccggatgccgctgtggtctgtcgtcagctgggctgcggggcggccatggccgccaccaccaacgccttcttcggctatggcaccggacacatcctgctggacaacgtgcactgcgaaggcggcgagccccgcctggcagcctgccagagcctgggctggggtgtgcacaactgcggccaccacgaggacgcgggcgcgctctgcgcaggcctgggtcccccaacgctcacagcactgccatcctcagccacaagagaggactgggcttggcagacagatccgtccgctacaggagttggcccccagccttcccgggagacagcactgctcaccaccgccgcctgggccgcggggaagaaaagtgggcggctgcgactggtgggcggcccgggtccgtgccgcggccgcgtggaggtgttgcacgccgggggctggggcaccgtgtgcgacgatgactgggactttgcggacgcgcgcgtggcctgccgcgaagcgggctgcgggcctgcgctgggcgctacgggacgaggctcgcctgagcgactgcttccacctgggctggggccagcacaactgcggccaccacgaggacgcgggagcgctctgcgcaggtgaggctgacagcgaaggcccagaggagctgggactgcaagtccagcaggatggttctgagaccacgcgggtgcccactcctcggcccagggacgggcatctacgtctggtcaatggagcccaccgatgcgagggacgtgtagagctctacctagggcaacggtggggcactgtctgtgatgatgcttgggacctgcgggcagccggtgtcctgtgccgccagctgggctgtggccaggccctcgcagcccctggcgaggctcactttggcccaggccgaggccccattctcctggacaatgtcaagtgccgtggggaagaaagtgctctgctgctctgctctcatatccgctgggatgcccacaactgtgaccacagcgaggatgccagtgtcctgtgccagccttcatgacccagcccgctctgcagaccacctcttcttctgggagctgtgacctcccttcctcctccaggaagccctcctcttgtgatgactacagttcactttgcccctccttcccttgcctgggagagagcctacctagacagtgcagtcctgcttgggggagcctggctgtacccccgtccacttactgcgtgacctcagcctgtcatcgactgttgtgagcccaattcagtgaaagctcctgtggttttgctcagccaaaaccaaaacgaggggaagaggatgattcctaactcttctgtttggtggggctctttttatagcaccagactctgccttccttgacctagatccaggaggctcaggggctctttaaatggggtatctcctcttcccccaacccatcttgggatccccaagaagagggaaggcaggaggggcctacagctcctaccttgggccctcaggggctgcagaggaacctgggtccctgtcctgccctgctccgcgagggcctggactaactcagatggtgctcggctggacaaggggactgggggaggggccaaagcagggacagtggcccctccctgcagctggaaccagcatctctgatttatgccgtctccaccacagagcctccactttgcaggagtgaagaaccctgggggcctgtagccaccagttcataggtgccaagtcaataaagcattgtcccccgtctcttataactgcag

SEQ ID NO: 293372 - DNA, 2000 bp, Homo sapiens
gctgtatcaaaaaaaaaaaaaaaaattagctgggcatggtgggtcgcaccagtcctagcactttggaataccgaggcaggaggatcacttgaggccagaagttctaggctgcagtgagctatgatcgcaccactgcactccagcctgggcgacagagcaagaccctgtctcgaaattaaaaaaacttttttttcaatgggatgatgctgagattgggaattgagagaccttatgagggggtcgattgagatgaaggttgagtcaaggttagcagtgcaattgggaattaggataggaactatccctgggcctgaagttagggtaatacctagaattagctttcggttcattcaaccaagtttcccggagatcccaacccgcgcccagacaacgtggtgactctggggttgcagctgagtgggggtacgggtgtggtagggttgggggtcttggtaggcgtccccgtgccctgctgcaggacagaaggcctcctcgtccccttcgaacgccctagatgccctgtctccacagctacaggagttggcccccagccttcccgggagacagcactgctcaccaccgccgcctgggccgcggggaagaaaagtgggcggctgcgactggtgggcggcccgggtccgtgccgcggccgcgtggaggtgttgcacgccgggggctggggcaccgtgtgcgacgatgactgggactttgcggacgcgcgcgtggcctgccgcgaagcgggctgcgggcctgcgctgggcgctacgggacgaggctcgcctgagcgactgcttccacctgggctggggccagcacaactgcggccaccacgaggacgcgggagcgctctgcgcaggtgaggctgacagcgaaggcccagaggagctgggactgcaagtccagcaggatggttctgagaccacgcgggtgcccactcctcggcccagggacgggcatctacgtctggtcaatggagcccaccgatgcgagggacgtgtagagctctacctagggcaacggtggggcactgtctgtgatgatgcttgggacctgcgggcagccggtgtcctgtgccgccagctgggctgtggccaggccctcgcagcccctggcgaggctcactttggcccaggccgaggccccattctcctggacaatgtcaagtgccgtggggaagaaagtgctctgctgctctgctctcatatccgctgggatgcccacaactgtgaccacagcgaggatgccagtgtcctgtgccagccttcatgacccagcccgctctgcagaccacctcttcttctgggagctgtgacctcccttcctcctccaggaagccctcctcttgtgatgactacagttcactttgcccctccttcccttgcctgggagagagcctacctagacagtgcagtcctgcttgggggagcctggctgtacccccgtccacttactgcgtgacctcagcctgtcatcgactgttgtgagcccaattcagtgaaagctcctgtggttttgctcagccaaaaccaaaacgaggggaagaggatgattcctaactcttctgtttggtggggctctttttatagcaccagactctgccttccttgacctagatccaggaggctcaggggctctttaaatggggtatctcctcttcccccaacccatcttgggatccccaagaagagggaaggcaggaggggcctacagctcctaccttgggccctcaggggctgcagaggaacctgggtccctgtcctgccctgctccgcgagggcctggactaactcagatggtgctcggctggacaaggggactgggggaggggccaaagcagggacagtggcccctccctgcagctggaaccagcatctctgatttatgccgtctccaccacagagcctccactttgcaggagtgaagaaccctgggggcctgtagccaccagttcataggtgccaagtcaataaagcattgtcccccgtctcttataactgcag

SEQ ID NO: 293373 - DNA, 1472 bp, Homo sapiens
gcacctcctacgacactgccgaatggaaaaagtgagggcagcgtacgcctggtagggggcgcgaacctgtgtcagggccgagtggagatcctgcacagtggcctgtggggcaccgtgtgtgacgacgactgggggctgccggatgccgctgtggtctgtcgtcagctgggctgcggggcggccatggccgccaccaccaacgccttcttcggctatggcaccggacacatcctgctggacaacgtgcactgcgaaggcggcgagccccgcctggcagcctgccagagcctgggctggggtgtgcacaactgcggccaccacgaggacgcgggcgcgctctgcgcaggcccagaggagctgggactgcaagtccagcaggatggttctgagaccacgcgggtgcccactcctcggcccagggacgggcatctacgtctggtcaatggagcccaccgatgcgagggacgtgtagagctctacctagggcaacggtggggcactgtctgtgatgatgcttgggacctgcgggcagccggtgtcctgtgccgccagctgggctgtggccaggccctcgcagcccctggcgaggctcactttggcccaggccgaggccccattctcctggacaatgtcaagtgccgtggggaagaaagtgctctgctgctctgctctcatatccgctgggatgcccacaactgtgaccacagcgaggatgccagtgtcctgtgccagccttcatgacccagcccgctctgcagaccacctcttcttctgggagctgtgacctcccttcctcctccaggaagccctcctcttgtgatgactacagttcactttgcccctccttcccttgcctgggagagagcctacctagacagtgcagtcctgcttgggggagcctggctgtacccccgtccacttactgcgtgacctcagcctgtcatcgactgttgtgagcccaattcagtgaaagctcctgtggttttgctcagccaaaaccaaaacgaggggaagaggatgattcctaactcttctgtttggtggggctctttttatagcaccagactctgccttccttgacctagatccaggaggctcaggggctctttaaatggggtatctcctcttcccccaacccatcttgggatccccaagaagagggaaggcaggaggggcctacagctcctaccttgggccctcaggggctgcagaggaacctgggtccctgtcctgccctgctccgcgagggcctggactaactcagatggtgctcggctggacaaggggactgggggaggggccaaagcagggacagtggcccctccctgcagctggaaccagcatctctgatttatgccgtctccaccacagagcctccactttgcaggagtgaagaaccctgggggcctgtagccaccagttcataggtgccaagtcaataaagcattgtcccccgtctcttataactgcag

SEQ ID NO: 293374 - DNA, 301 bp, Homo sapiens
gtgcgacgatgactgggactttgcggacgcgcgcgtggcctgccgcgaagcgggctgcgggcctgcgctgggcgctacgggactgggccacttcggctacggccgcggccccgtgctgctggacaacgtgggctgcgccggcaccgaggctcgcctgagcgactgcttccacctgggctggggccagcacaactgcggccaccacgaggacgcgggagcgctctgcgcaggtgaggctgacagcgaaggtgaggctgacagcggggccgcgcactgcggcgtgggaggggcggggcggcgc

SEQ ID NO: 293375 - DNA, 1762 bp, Homo sapiens
ctcaaatacacatcaccaaacaaattttctctattatttgggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293376 - DNA, 1268 bp, Homo sapiens
aaaatttaacttttcatgtaaatgattttaactcgagttttcaacaatttttttcttctctttttttctttaacatacttccaaaaaatgctactacagactttaggcatgtggtgaatgaaatgctcttaggattattttcactttggggtgatggtgagagtgtatgcttatctgtgttgagtgtgtttgatctctgaatagattttatttgtattgatttcatagtttataaaaggaaaatatttaaatcatttaccatcttctattaatgggaaattttactcatttttatagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagatggagtttcgctctgtcgtcaggctggagtgcagcagcacaatctaagcttactaccacctctgcctcccgggttcaagcgattctcctgcctcagccccccgagtagttgagactacaggcgcgcaccgccacacccagctaatttttgtatttttagtagagatggggtttcaccatgttggccaggatggtctcgatctcctgaccttgtgatccgtctgcctcagcctcccaaagtgctgggattacaggcgtgagccaccacgccgggcctaccatgactatatttaagagactgacaatattttggagataaatttaatatttttattagcacatttcactcattcctttattccttctcctttctcttccttggttttgatcacagtcaatgtgagggaaaagtaaatttactggaaaagctaactggaaatatttttattgtgggctttctgaaataaatttaattattaaatagggtcttgtttgtgtctcatgaacttaaaatattcttattttccaaaataaataattaaatatcctttatggaatt

SEQ ID NO: 293377 - DNA, 7504 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293378 - DNA, 7446 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggtttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293379 - DNA, 7450 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293380 - DNA, 5271 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgcta

SEQ ID NO: 293381 - DNA, 7466 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactgggtccgcagccggtccacctcttccgacaggctctgcctctccaggagaagctggttctgcttgctgaggagctgcaccagctgctgggctgtggcctggctgtgcttatccagctgccttagctaaaaatttgttgggttttgaggttttacggcaagagtagattatacataatttcgaccat

SEQ ID NO: 293382 - DNA, 7350 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactttgcttcatcgtctcatgtactctcccatgctggacacactgttcctccaattcttcatttcttctctgt

SEQ ID NO: 293383 - DNA, 7623 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgctttgactttaacataaacaaaaatgtcaaccaatattcatgttggaactaatcgtaagtttcatccattagtggctttggcgtacagcagaaattaacaagttttctgtgagaatcagccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293384 - DNA, 7299 bp, Homo sapiens
aggctgataagatggcagcctggcaacagaggcaggtagtggggttgggggagaacatttgatgcagagtaaaaataagatttgtgattccaaaggtcatgaattgttaggatcatgggatgactgtgtatcattggaagatgtaagctcaagaatattcatgaatatgtgttctattaaacattggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293385 - DNA, 7172 bp, Homo sapiens
aaaatttaacttttcatgtaaatgattttaactcgagttttcaacaatttttttcttctctttttttctttaacatacttccaaaaaatgctactacagactttaggcatgtggtgaatgaaatgctcttaggattattttcactttggggtgatggtgagagtgtatgcttatctgtgttgagtgtgtttgatctctgaatagattttatttgtattgatttcatagtttataaaaggaaaatatttaaatcatttaccatcttctattaatgggaaattttactcatttttatagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293386 - DNA, 6770 bp, Homo sapiens
gtgagggggaaactgcaatctgatgatgcatacctttttcctctggtaactgaaggttaaatgggtagcaagcagaatgccttaaacaagattggtatattgattaaaacgctgatttaacagctcgcagtttccccttggaaacctggaaaagataagccagctgctgtctaagagtgctcagtgtccactgagagtacactatctatcatcacaatatggtgatgagaggtgttttatgtttgtgttaatttcccccactaaatcagtaattattacaatcctgtccctgctgtttaccctgcagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293387 - DNA, 6332 bp, Homo sapiens
tttatcatagggaaattgggaaaggtgagttaagccagatgctagatgttgaatgaaatttcataagaagctttattttgcagttgcacttaaagcatcacaaagaaaaaatataagcacttgaagacattcgatgatgaattctatacagactttggatgctgtggatttcactgacttgcagttttgatatatgtggttacatgaaatgaaaggttactgaagactgctccttcttaaaaacttctgttttcttcaataccatttttttcactgtttcattgagtcttgaaattttgatgtcttagagatgattctatagtattatttcttcatagactatgtatttatgaaaatcagatgatttttgaagtataattactctacagcttattgatgaacacaagtttatgggagctattgcctctgttcatctttcctatgttcagagtttaaaaaacatagactagagataatgttgcaaaaaatgaatgtgtaaaattaaaatagatgtttcctgcccacagatgatgaggatggtatggactgcatggacaatgagaggcggccgcatttccctcaattttcctactctgcaagtggacgagaataagtctctttcattctgctacttcactgtcatcttcaatttattactgaaaatgattcctggacatcaccagtcctagctcttacacatagcaggggcaccttccgacatcccagaccagccaagggtcctcacccctcgccacctttcaccctcatgaaaacacacatacacgcaaatacactccagtttttgtttttgcatgaaattgtatctcagtctaaggtctcatgctgttgctgctactgtcttactattatagcaactttaagaagtaattttccaacctttggaagtcatgagcccaccattgttcatttgtgcaccaattatcatcttttgatcttttagtttttccctcagtgaaggctaaatgagatacactgattctaggtacattttttaactttctagaagagaaaaactaactagactaagaagatttagtttataaattcagaacaagcaattgtggaagggtggtggcgtgcatatgtaaagcacatcagatccgtgcgtgaagtaggcatatatcactaagctgtggctggaattgattaggaagcatttggtagaaggactgaacaactgttgggatatatatatatatatataattttttttttttaaattcctggtggatactgtagaagcagcccatatcacatgtggatgtcgagacttcacgggcaatcatgagcaagtgaacactgttctaccaagaactgaaggcatatgcacagtcaaggtcacttaaagggtcttatgaaacaatttgagccagagagcatctttcccctgtgcttggaaaccttttttccttcttgacatttatcacctctgatggctgaagaatgtagacaggtataatgatactgcttttcaccaaaatttctacaccaaggtaaacaggtgtttgccttatttaattttttactttcagttctacgtgaattagctttttctcagatgttgaaactttgaatgtccttttatgattttgtttatattgcagtagtatttattttttagtgatgagaattgtatgtcatgttagcaaacgcagctccaacttatataaaatagacttactgcagttacttttgacccatgtgcaaggattgtacacgctgatgagaatcatgcactttttctcctctgttaaaaaaaatgataaggctctgaaatggaatatattggttagaatttggctttgggagaagagatgctgccatttaaccccttggtactgaaaatgagaaaatccccaactatgcatgccaaggggttaatgaaacaaatagctgttgacgtttgctcatttaagaatttgaaacgttatgatgacctggcaacaaaaagtaatgaagaaaattgagacctgagtgaagataagaaatgatctttacgtggcaaaatgaacacatcttgagtatttaggaaatgggcagtgaaggctaagaacctggtgtgtttcttgggatcatggtacatttatcactgaattaagccatcagggaaaaaacaacaaaaaaagagaacacctccagcttttctttttctgtatatactcatgtcccccagattccaacatttctcactgaaagggggcatgtatgcaaacctcatctttctccttcattaatgatgatcttcagattaaaccctttggtgctaggagctgacaatttccaaagcagcctgtgaagtcctaggggctgggggccactcttgcggcaagcagaaggccatcctactccgcggagtgatcatggaaatgtattttagttaaactctgacagctcccaaacggaagactacagcatgacgtagtattatgattgcattgtatgaaagagcaagtgactttctaagtaggatgaatcatattcatatgcagatgtcttagcctcttgacgctggaagtgtggatttatagctatgaaaccactgctggcagtgggtgggccactgggactgacgggggttaaagggcattttactaaggcagctaagacatattcagacatcaacgttatccttctttttcatatttctacctgagtgaagttcatccttagtattgagtaggaagttacagtaaatggtagttcattcttacttacacacatagctaatcttttttttttcacttggaattatgttgaatgtttcattttgacaaaaaagtagactagaaggtatgttctttaagttgtcttgcatccattatataagaaagaaacaggtgagaggaagagcagaaagctgagactggctgatgttcagagcacttactcctctagagggaaagcatgacaccgaacactaagcacacagctttttgttgttttggttttttctcccgcaaatcttaaagtgattcccatgaccttggccaaggacacttcttaaagattaatgactggcactgacattgccccaggcgggccactcctcacactggctctcagttcccagccatgcctggggctcagtcacttctattccaccctctgagactccattggtgtcacacaaggtgtcttcttggctttgattttgagaatcccctattttcacttccagatctgtcagctgccatggaggaataatagaaaaccagaaatgcgtgtagagggagatttctaaaacttcccttgtgtcgcccatagttgtagttttgggttctggcaggtggaacaccctgaaacctggaatcattctatgagaatacagttcagactttgcagactccagcccatactaactgtcatgaagcttgacttcttgtcataatgcagccatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293388 - DNA, 4541 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatcttggaggaaattggccatttctgcttagatggttggcagggtcgcgctcagctttgctttctacactaattacatagcattattcaagtattgttttccatttcccatccctgatttccagcttcttaaagctgactgttcttgcaggggccacttgcttctcctagagtacaaaagtaagggccttccttactaactgcagggtctctctattacacctcaacatacacactttgctgctactgtttgtactgtctacagtagaatttccttatcttgctcctggtagtgcattacaggcaagcatgaaatgtaaagtatttatttaaataaaaagaaaacctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggcctagttaaaatatgtgcctttttggtgtgttttgttcatcactacaagataaaaaggaaacattacaactcaagtctttaaaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293389 - DNA, 1967 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagctgtttttccatttgtcgagagagcgggtgttctctgaggaccgcacacgtttctatggtgcagaaattgtctctgccttggactatctacattccggaaagattgtgtaccgtgatctcaagttggagaatctaatgctggacaaagatggccacataaaaattacagattttggactttgcaaagaagggatcacagatgcagccaccatgaagacattctgtggcactccagaatatctggcaccagaggtgttagaagataatgactatggccgagcagtagactggtggggcctaggggttgtcatgtatgaaatgatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaagcttgtacctccttttaaacctcaagtaacatctgagacagatactagatattttgatgaagaatttacagctcagactattacaataacaccacctgaaaaatgtcagcaatcagattgtggcatgctgggtaactggaaaaaataataaaaatcggcttcctacagccagcagcacagtcacccatggaactgttggctttggattaaatgtggaattgaacgactacccagaagtgttctggaaagaagcgagatgtgtggcctgcctcaccgtcctcacccatcaaaagcaccagcaggcacgttaactcgaattctcacaaggaaaaggccattaaagctcaaggtgcatttcaaactccaggctac

SEQ ID NO: 293390 - DNA, 1600 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaaaatgccagttaatgaaaacagaacgaccaaagccaaacacatttataatcagatgtctccagtggactactgttatagagagaacatttcatgtagatactccagaggaaagggaagaatggacagaagctatccaggctgtagcagacagactgcagaggcaagaagaggagagaatgaattgtagtccaacttcacaaattgataatataggagaggaagagatggatgcctctacaacccatcataaaagaaagacaatgaatgattttgactatttgaaactactaggtaaaggcacttttgggaaagttattttggttcgagagaaggcaagtggaaaatactatgctatgaagattctgaagaaagaagtcattattgcaaaggatgaagtggcacacactctaactgaaagcagagtattaaagaacactagacatccctttttaacatccttgaaatattccttccagacaaaagaccgtttgtgttttgtgatggaatatgttaatgggggcgagatggagtttcgctctgtcgtcaggctggagtgcagcagcacaatctaagcttactaccacctctgcctcccgggttcaagcgattctcctgcctcagccccccgagtagttgagactacaggcgcgcaccgccacacccagctaatttttgtatttttagtagagatggggtttcaccatgttggccaggatggtctcgatctcctgaccttgtgatccgtctgcctcagcctcccaaagtgctgggattacaggcgtgagccaccacgccgggcctaccatgactatatttaagagactgacaatattttggagataaatttaatatttttattagcacatttcactcattcctttattccttctcctttctcttccttggttttgatcacagtcaatgtgagggaaaagtaaatttactggaaaagctaactggaaatatttttattgtgggctttctgaaataaatttaattattaaatagggtcttgtttgtgtctcatgaacttaaaatattcttattttccaaaataaataattaaatatcctttatggaatt

SEQ ID NO: 293391 - DNA, 1375 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttaccttatcccctcaacaacttttcagtggcaagtagtgttatgttcagatatttgcagaatttaaccttaaaccaagtttagaattgggaatggagaaaacctttgtaaaaattattttaaaatgagatcatttttaagaaaactataatgtaacaatgtcacatatttccttcttcaggctccaattcaaatcatactccaatttgaaaagaacaaaaattccacaaaacgttcattctttcctactttttccttacgttgtacaacaaatgtggaaagaaaaaaaaaacagaaaaagtgtatcccatcttaatgaaaatgactgcggcagtcaagagtttcaaatccagctgccaggggtgaaagcaaccctctgcatctctgaaagatttcatcagtgttatctcctttataatcataacttttcatgtgtatcatctgagtttcttattaaataatctcactattttaatagttccttcattataacactacaggtgatctgatcagatttctgttttagagcctgcttcctcttctttagtagcttccacgatctcccagccttttcctgatttgtattcccaagccaatcattttagttacagtctttactttctgagcctcttttatcagaatataaggaatggggggcttatttagaatcaaagggaatggtaaacttgtagacagacagctgaccatgcatactcattttaaaaatgtcccacagcattttattacaatatctggtatactggaacatcattgcgacttgtagtcagaagacctgactttgggactaggttctacctgctttactagctatgtgatcttggcgcaatcacttaacttctctgatttccatttgcttcatctttgaaccatg

SEQ ID NO: 293392 - DNA, 594 bp, Homo sapiens
  misc_feature (1)..(1): n is a, c, g, or t
  misc_feature (5)..(5): n is a, c, g, or t
  misc_feature (9)..(9): n is a, c, g, or t
ntccnccgnagagctccaccgctgaggccgacgaggccgaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactggaaaaaataataaaaagtaagtttcaatagctcatgttcttcaatgttatttgtcttctcatttgctggtttagtcaccttttatgatgaaaactgttgttggagaaaaaaacctgttgctaaaaatgtggaaattatatgaaaagtttgtgcctcatcttgtccacatcaaagcccttcacatatgaaataaggttaactggtttaatgggttaaatttgaa

SEQ ID NO: 293393 - DNA, 556 bp, Homo sapiens
  misc_feature (1)..(1): n is a, c, g, or t
  misc_feature (5)..(5): n is a, c, g, or t
  misc_feature (9)..(9): n is a, c, g, or t
ntccnccgnagagctccaccgctgaggccgacgaggccgaaagttcatttattgaaaatcatatgtataacctagcatacgaatgagcagatttaaacacataacttcaagccatttctgaaaacatacaccaggagctctgctcagctagagtcagactccagctccagcccgactgcgtgcggggacagcgcccgcgttgatgaggaccagccccactgcaggctgaggcggtgtcaccctgggaaggtcgtggtgcgttgtggcatattaagtctaaaccagatgaatgtaaatatctctttgtaaatcatttatttcactctgttccatccaggtcagcaatcagattgtggcatgctgggtaactgggtccgcagccggtccacctcttccgacaggctctgcctctccaggagaagctggttctgcttgctgaggagctgcaccagctgctgggctgtggcctggctgtgcttatccagctgccttagctaaaaatttgttgggttttgaggttttacggcaagagtagattatacataatttcgaccat

SEQ ID NO: 293394 - DNA, 722 bp, Homo sapiens
gatgtgtgggaggttacctttctacaaccaggaccatgagaaactttttgaattaatattaatggaagacattaaatttcctcgaacactctcttcagatgcaaaatcattgctttcagggctcttgataaaggatccaaataaacgccttggtggaggaccagatgatgcaaaagaaattatgagacacagtttcttctctggagtaaactggcaagatgtatatgataaaaaggctgagtcatcactagagagtgggaaggggcagcagcagagaatccaaaccctaaagctgatatcacaaagtaccatttctccaagttgggggctcagaggggagtcatcatgagcgatgttaccattgtgaaagaaggttgggttcagaagaggggtaagtgctccgcaaaccaaaaataatacggttggtaagagtgctagcagtgagtggtgtcttagaagttgatcttttttctgatactgttaaactgtgtcatgctatgtctagtaagagagaaatgatatatttaacgtgtgttaggaatttgcttgttattaagggatttttttgtaattcttgattttgagcatttataatctagttaagttaggtttgactttctggtatgttgtgtgtagcgtgttacagaaagtgttgtatttttctgtggtgtctacaggttctgtaatctggagagatatctttagaatcatttaatatatgt

SEQ ID NO: 293395 - DNA, 305 bp, Homo sapiens
ggaaaatactatgctatgaagattctgaagaaagaagtcattattgcaaaggtaactgatttattaaagttgattactaaatttttgtttgcagtgtgcatgtgtttgtgggctcatgaatttacatgctaatgtatgcaaattccattaaacaaccaaaatatggttgtagactactgctacagtaatttttgtgtattaatatttgtaatttttaaagttttcagacattcataatatttgtatattatatactaaagctattctcttaaggaaatagaaatgtttatgtttgcatgtttggg

SEQ ID NO: 293396 - DNA, 374 bp, Homo sapiens
tctggagatcttaatttttttggtgcagccaaagaataagtcctccagggacaggtagagatcccgttcgacttgggggtcctgcttcttgacccctcggccctggagccccccaaagttcaaatctacctcacttccttctgcatcaaaaaactctgcaggaggaaagggaggcactccctctggtggccgcgctcaggagtgccagaagagactgctggtagtcctcggcaggaagtgcaaagacagccccatcctggctctgcccctgatgtgctgtgtgatccgtgggcttcagtgtcttggtctgtgggatggggtaataatgcctgacctgccttccaccattaagatgaagagctaaaacttgctga

SEQ ID NO: 293397 - DNA, 1482 bp, Homo sapiens
ctttggtgctggaagaattcgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagta

SEQ ID NO: 293398 - DNA, 1484 bp, Homo sapiens
ctttggtgctggaagaattcgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttacttgacgtcttgtatctctttttattttcggattgcttatca

SEQ ID NO: 293399 - DNA, 1201 bp, Homo sapiens
ctttggtgctggaagaattcgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaattttt

SEQ ID NO: 293400 - DNA, 1429 bp, Homo sapiens
ctttggtgctggaagaattcgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagta

SEQ ID NO: 293401 - DNA, 1000 bp, Homo sapiens
  misc_feature (54)..(54): n is a, c, g, or t
tctctctctctctctctctctctctctctctctctctctctctctctctctctnctcgtgccgaattcggcagagtttctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcgggggacactgtatttgatatttgtgatcagtgatcattgttcaactgcgaaatagagtgtttgcttttgataatggaaaattgtattcgttttaaaattccgtttgttgagaataacaatatgtttaaaaatataattgaacaaatttttttctttgtttcctgtcattgacatttagtataacagttttgctaacgttctaaaatgaagtcgttccatcataatctatgatcttgtacagcacttatagaaataagctgttcttttgaagttgaaatacccagtaaaatgttgaagaaggatggaggatttcttcatatctgacgtttctgaaaccctttgtgtctgctgttgtgtgaagattgacatttaccatgattttccttagttactgcagaacatagagaaaaataaaagcctaacgaatagta

SEQ ID NO: 293402 - DNA, 1106 bp, Homo sapiens
  misc_feature (1079)..(1079): n is a, c, g, or t
ctttggtgctggaagaattcgcgtggcaggagaggcggggccaattttgctgagctttctcgcgggcttgcagctgcggcaagtgctggcggcggctgctcgcgcaagtcagctggcgtgggaactaccctttgtagctgagaacggcttgtttattgctacaaagactctattgacattggtagcttcagcggcagcagcttcttacggtataaagctgttgcttcctgaagaggctacaagcatccttccctaggactgctgtaagctttgagcctctagcaggagacatgcctcggggacgaaagagtcggcgccgccgtaatgcgagagccgcagaagagaaccgcaacaatcgcaaaatccaggcctcagaggcctccgagacccctatggccgcctctgtggtagcgagcacccccgaagacgacctgagcggccccgaggaagacccgagcactccagaggaggcctctaccacccctgaagaagcctcgagcactgcccaagcacaaaagccttcagtgccccggagcaattttcagggcaccaagaaaagtctcctgatgtctatattagcgctcatcttcatcatgggcaacagcgccaaggaagctctggtctggaaagtgctggggaagttaggaatgcagcctggacgtcagcacagcatctttggagatccgaagaagatcgtcacagaagagtttgtgcgcagagggtacctgatttataaaccggtgccccgtagcagtccggtggagtatgagttcttctgggggccccgagcacacgtggaatcgagcaaactgaaagtcatgcattttgtggcaagggttcgtaaccgatgctctaaagactggccttgtaattatgactgggattcggacgatgatgcagaggttgaggctatcctcaattcaggtgctaggggttattccgccccttaagtagatctgaggcagacccttgggggtgtaaaagagagtcacaggtaccccaaggagtagatgccagggtcctaagttgaaaatgatgtcgattgggggcggggactgcttcagtttctgtcgacccgnccgcgaatttagtagtagtagtcgacc

SEQ ID NO: 293403 - DNA, 431 bp, Homo sapiens
cctatgagaagcccctttcaattccttgttgagacctctacagttcctttggagtgctttccccgctcctgcagcaagactttcttgcaaaaatgcctgtttgggattcctcagagtacagacaaaaaggaaggcttgatcagcatgtggtggatctgaagattcaaagaggtgccacagctcaaaagtagacattttggcaaatgtgaagaagtgagattcaatgaagatgataagaaatgaaaggtgttaccaaaagcatcctgtggtgactgaagaagggcctagcagcaaagggactccatcgcccgaggagcagcttccgcaggagctccggcaggttccttggaaaacgtggcagtgccggcccatggtgccctgttcagaaatacaagactcagatttagtaaagccagttgtgtaatgtgaaa

SEQ ID NO: 293404 - DNA, 857 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaata

SEQ ID NO: 293405 - DNA, 469 bp, Homo sapiens
  misc_feature (24)..(24): n is a, c, g, or t
ctactactactaaattcgcggccnctctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaata

SEQ ID NO: 293406 - DNA, 964 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaa

SEQ ID NO: 293407 - DNA, 1155 bp, Homo sapiens
  misc_feature (1155)..(1155): n is a, c, g, or t
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaacaaaaacacaacaacacccgttgggcgcgccgggcccggggagggtttaaaccatcggggggggcgggcccgaggtttgggcctggcaaagcgtccaagagacccggcacaagcgggggttcccccaaaaaagccgggggaccgggtcgcacacccgggggccgggcctggacacacggcccggcgcaagn

SEQ ID NO: 293408 - DNA, 990 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaagctaccagctgctgaagcaaacatga

SEQ ID NO: 293409 - DNA, 1101 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaataaaaaaactttcaagttcttttgtcggttatgtcggcccgcctgggccccagtcgacttttagactcagacaaagcttaatgcatgcggcccgtaattcgagctcactggcccaattcgcccctataggcgagctcgatttacaattcactcggccgccgtttaacaactgtgggactgggaaaaccttgcggtacccaaccttaaccgccttgcacccaactccccctttccgcagcttgcgga

SEQ ID NO: 293410 - DNA, 1406 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacggaaaaaaagtctctcatccctgacctcgagtgacccaagccagcagtgtcacaatctactcagcaaacacaacttccccacccacaatacgctctagatgaaagttcaaaacaatcccgaactgcgggaagcgccatgatgccgtttcactattaatgcggatcccactgatgagagctgccaaaaacgcttgaagcgtcattgaattgtcaacgaaaagagtccaactctgtaaaatatttgaagagacttattctgagccaaatatgagtgaccatggcccttgacacagccctcaggaggtcctgagaacatgtgcccaaggtggtccggtacagcttggttttacatattttagggagatatgagacttcagttcattcaagaaatacactggttgggccgggcctggtggctcatgcctgtaatcccagcactttgggaggcctgggcgggtggatcagctgaggtcaggaatttgagaccagcctggccaacatggtgaaaccccatctttactaaaaatacaaaaattagccgggagtagtggtgggtgcctgtaatcccagctactcgggagcctgaggcaggagaatcgtttgaacccgggaggcggagattgcagtgggccgagatcgcgccccattgcctggggtacaagagcgaaactccgtctcaaaaaaaaaaaaaagaaagaaagaaagaaagaaatctgggatatgatgaggtttctcttcaaataattagatcaatc

SEQ ID NO: 293411 - DNA, 904 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcctccagggtgcagaatagttaaagacacctccctctctctcttcagcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaata

SEQ ID NO: 293412 - DNA, 979 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcaggtgaggcgcggcgtggtgaggcgggcgggcttcgggacgccagggtcacgacctcgacctccctgaagttgagggaagcccccgcccacagcacgcgcggcgctctctccggccccgcagggacttcattgagaaacgctacgtggagctgaagaaggcgaatcccgacctacccatcctaatccgcgaatgctccgatgtgcagcccaagctctgggcccgctacggtgagtgcgggacgccaggggtctggggctccggtaggggaacaagggtttgagaagagaagggaccgcccaaggtcgtgcagaaacccgtggagaaactagaactcggactttagccttgctgttgatcttgtttccatgaagaaatttatattcgcagggttatatgatgcgttgtattccgggcaacataagtatgcaggctga

SEQ ID NO: 293413 - DNA, 576 bp, Homo sapiens
  misc_feature (24)..(24): n is a, c, g, or t
ctactactactaaattcgcggccnctctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaa

SEQ ID NO: 293414 - DNA, 1171 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaaaaacaaaaaaaaaaacaaaaaagaaaaagctttgttctggggcccgccctcgggccccttcgaaaaagagctctttcatagaacccattgtgctgtgtggggccgcggggggcccccaagttggggtttaggtgtgaaccctggtggtccaaaaacggcgggtcccccagagggaaagaactcgcgggcgccgtaggaaacatgcgt

SEQ ID NO: 293415 - DNA, 1015 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaataaaaaaaaaaagagaaaaaaaaaaaaaaaatttgtggggggccgggcctgggaaaagtttttagaaacacatggttggggggggggggcccagggttgggaatgggccaaggggtcccaaggaaaccggggaggaaagggggtgggttttcccataaag

SEQ ID NO: 293416 - DNA, 1011 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcagggacttcattgagaaacgctacgtggagctgaagaaggcgaatcccgacctacccatcctaatccgcgaatgctccgatgtgcagcccaagctctgggcccgctacgcctccagggtgcagaatagttaaagacacctccctctctctcttcagcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaa

SEQ ID NO: 293417 - DNA, 1084 bp, Homo sapiens
acacacacacacacacacacccggcttaagctcagaagctacaataatgcgccaagtgccccaagtgccatggggaagaaataacggatggcctgagccttactatctcgctccggcattttgttatcgttctttcgctgtcaccaacaatcgagtctccaacagcaacaccgcagcgacaagctctttcccacagtgcacctcagaatcaacccacactgctttgcgttcgcagcctttccgcttcctgtttttccctccgaccaaccccgagcgcaaagaaattgacctcgcagcggtcctacaatacttttatatcattggccaagctttaccccgcccctgcctcatgcagcctatgggctaggctttagggtccgcggttggtcagaccggagcacttggcctgaagacctggaattggcgacttcgatattaacaaggatggcggcggccgcagcaagtcgaggagtcggggcaaagctgggcctgcgtgagattcgcatccacttatgtcagcgctcgcccggcagccagggcgtcaggtgaggcgcggcgtggtgaggcgggcgggcttcgggacgccagggtcacgacctcgacctccctgaagttgagggaagcccccgcccacagcacgcgcggcgctctctccggccccgcagggacttcattgagaaacgctacgtggagctgaagaaggcgaatcccgacctacccatcctaatccgcgaatgctccgatgtgcagcccaagctctgggcccgctacgcatttggccaagagacgaatgtccctttgaacaacttcagtgctgatcaggtaaccagagccctggagaacgttctaagtggtaaagcctgaagcctccactgaggattaagagcaacagccccagagcctgggctctgctggacttagtataatgtgaaaaaaatgtgttctcctattcctcataaagcttgtgctgtaaaatactttctcagggtgttcttgtcctcatctaccctctaccccttactgtgcaaccactgaggcaaagtagcttaatataaaaataaaactttattctgtctcatcaaaa

SEQ ID NO: 293418 - DNA, 421 bp, Homo sapiens
ctcggctcggatctaccttccagtagcagcggagtggccaatgggaccgggaccagagccgggggccggaggccgccgccgcggggaggttcccggcccaggtgcccagcgctcaccagcccggcggcgccgcggcggccccgcagctgtttcctcgggggggcgtggcgtcgggggccttcgcggcgcagtcctctttcagcatcccgaacagcagcagcggcccgtaggactcgcaggactcggtgcacagcagccctgaggatggcggcggcggccggcaccggccggtgggctggagccccggcgggccgctcctggtgatcggctccttaccagctcacctctcaccgcgcatgtttggaggtgctgagaaacataatgtctgttccccaagagccagctaatcatttttactaag

SEQ ID NO: 293419 - DNA, 2829 bp, Homo sapiens
gggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcacgccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcctccccttggcggggagaagctttttttcttgctagtattcgctgtgttcatggtctagaaatgcggtctggtctcgcctcgcctaccaatctctgctctctatgtatgtagcgtacgggttgttttgggtgaatcttgaggaataaatgcctttatatttcacaggctgtaaattgaacttcccacacgattagctttattatggcttgtgaactgctggagtctggctttacctttttgtatgtgaacaaatcaaattgcttaaaaaagagttttctttagtatagccacaaatgccttgaactgttgtctgggattgttttgtggggggagggaagggagtgttccgaagatgctgtagtaactgcctcagtgtttcacgtaagactttttggtttgatcatctttgttgaggtaggactatcagttccctctaaatgtatatgttgatttatgagtaattgttatttattctttatttatttatattaattatgaagattatgatattatttgattgcagatttttttggcgcgctgccccctccccaccctgccactcttgacattccactgtgcgttttagaagagagcctttttctaaagggatctgcttaaagttttaacttttatacctatctgagtgaattacagacaacctatcatttattctgcttcgagggtccccagggcccttgtacaaccgacagctcttacttttaaatgcaatctcttttctacatacattattttcttaattgttagctatttatagaaagcttcaatagaactgtttcaactgtataactatttactattcaaataaaatattttcaaagtcaaa

SEQ ID NO: 293420 - DNA, 914 bp, Homo sapiens
gtccggagtccgggcgttctggcagcaccagagtcctgcagcagagacgggctgggctggcactcacccacgaccccccttccctgctatgatggtttgtcagtagcaggtcctagacaccccccgcccgctcccggggcacgtgggcagagctagcagcagccaggtgcacggagccacaagagctctagggcactctgggggcagctgtgcctgctgccctctctggtgcctgtggagatgcctaactgacaggagagttagtgaggacaagaacgctcccttttggccgaggtccgctgtatccatggctctcctgaccaatctactgcccctgtgctgcttggcacttctggcgctgccagcccagagctgcgggccgggccgggggccggttggccggcgccgctatgcgcgcaagcagctcgtgccgctactctacaagcaatttgtgcccggcgtgccagagcggaccctgggcgccagtgggccagcggaggggagggtggcaaggggctccgagcgcttccgggacctcgtgcccaactacaaccccgacatcatcttcaaggatgaggagaacagtggagccgaccgcctgatgaccgagcgttgtaaggagcgggtgaacgctttggccattgccgtgatgaacatgtggcccggagtgcgcctacgagtgactgagggctgggacgaggacggccaccacgctcaggattcactccactacgaaggccgtgctttggacatcactacgtctgaccgcgaccgcaacaagtatgggttgctggcgcgcctcgcagtggaagccggcttcgactgggtctactacgagtcccgcaaccacgtccacgtgtcggtcaaagctgataactcactggcggtccgggcgggcggctgctttccgggaa

SEQ ID NO: 293421 - DNA, 317 bp, Homo sapiens
aaaaatgaccagattcccaccacctaaagataagtcctgtcatcctttcaggaattaatatatcaatttctcatctactcttctctcacactactttgcataaatgggatcataaatgggatcctatattttttcaagcaacagtgtgttatgcctatactccatgtttatatgtgtgtattaaaaaatgtatttgtatatatgtgtatgtataagtgtgtgtgtgtgtatgatgattcttctcccgctttgaaggtgaaagaaagcacacctttatttaagcataaactttgggtttcagatactgtctggaaaaa

SEQ ID NO: 293422 - DNA, 1692 bp, Homo sapiens
  misc_feature (504)..(504): n is a, c, g, or t
  misc_feature (1127)..(1127): n is a, c, g, or t
  misc_feature (1228)..(1228): n is a, c, g, or t
ccccaacctaagagtgcacatctgtgtgcctagcctgatccaggattcacgtgagggacctgtgtctgtctatcccactagcttaggggcaggatcctttgagcctatccacccactgccctggcaccaggctgctgggctgggacccactacccatcccacctcctcatcctcaggcagcgggggcaggggtgagctgggagagcattcacgctcgcgcacagaggggctgttgcgcatccaggcgcggcagattgggtacagtggcgtgttctcgctgaactgggccaagtccacgctccggtcgaacagcttgatcacatatgtgtctgggaaggtggggatgggaggtgtgtgagcatccttgcataggcccttggctccttaccgaccctctagggccactgtctactcactggatcgctgcggccctccctcagccagcccatcatccatctccctcctcttcttcctccgctggtgggggaagcgggcagatggccngcgtagggagagggagtgtcaggactggggtaggagctgggagcctctagtcagctggctgggaccctgccaccttaccttttgccagtggctgcgatggagcagtccctgtggggaaagacagttgaccctcagacaaacgcctgtgcaaaaccctgcagagggcaccctggggatactggtatcaaacctgagatgctcacatgaaccccacttgcctcttgggccttttgtcccacccatacccatgggggtctaggtggcaaccacggggggacctaagcttctcctgccacagggtctttgtacaggtggagtggtccgggccacgatggaggtagcgctgggctgagcggtcagggcttggataaggaaagaagttaccaaccacgaactctcaactccaaatccaatcagaaaaactcacttattgtgggtgtctgagggtgttttcccagcttcctcatccagacgctccctagaggcagaagagatctctcagctcagggttccagggccccagagaaggaaggcaccgagcagcctccccattaagcaccttcctccccaagtcagcctgtggggtcccacccaatccacccaggatcagagggcccaacccnccagggtgcccggccctgtgaccccacgctggcctacctgtccatgtgactcttctccagcagacactgcaagacagcatccagttggttccgggctttgnccatctccagctctggggcaagagaggacccagcaggagtcagctcccaggccccagctaggtgggcagctgactgggccagggaagggcgtgcgtgtcctctgccctggccaatctcagagccaggcccaggcagcctgaaagggtgcaacaggcagagatggctggagtgatgcccagagctctgagttccagagctgtcccacgtgattgctctgtgacaggagacaacacttccttcagaaaacgggaaacttccatttgtcacacgtcttggtccagataaatcccaggaagtagcatcgtgatctacacttctgatgagaatactgcagcccacagtaggaaagttatatttttgaattcacgactaccagtacaggataacagcccctagaaatggaagcactaggccgatcctaccactgcactccagcctggctgacagagcaagactctgtctc

SEQ ID NO: 293423 - DNA, 275 bp, Homo sapiens
ttctctgagaaagctcttgactatttttatttttgcagacaacacttccttcagaaaacgggaaacttccatttgtcacacgtcttggtccagataaatcccaggaagtagcatcgtgatctacacttctgatgagaatactgcagcccacagtaggaaagttatatttttgaattcacgactaccagtacaggataacagcccctagaaatggaagcactaggccgatcctaccactgcactccagcctggctgacagagcaagactctgtctc

SEQ ID NO: 293424 - DNA, 260 bp, Homo sapiens
ttctctgagaaagctcttgactatttttatttttgcagacaacacttccttcagaaaacgggaaacttccatttgtcacacgtcttggtccagataaatcccaggaagtagcatcgtgatctacacttctgatgagaatactgcagcccacagtaggaaagttatatttttgaattcacgactaccagtacaggataacagcgcgcataataagctttcaggggggggggctcaggcgctgcagagccagactctgtctc

SEQ ID NO: 293425 - DNA, 967 bp, Homo sapiens
tgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccagcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgctttca

SEQ ID NO: 293426 - DNA, 1111 bp, Homo sapiens
tgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccagcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgctttcattgctggttgtcagtttttaaattctctttttcccttatgtttctttcttgtttcgcgtcgcttattactttcagtttccttgtattttaaatatttgtatttatttcattaaatatttcattcgtatctgttactttgagaaa

SEQ ID NO: 293427 - DNA, 1313 bp, Homo sapiens
tgtagcgctagttctcttcaagatttgcttagtgtcatttcatttcggtttcttttctcgccatgtttttctgtcggaattacggttcgttttggttctatgtactctctaaaatgttatcgtttttcatttgtctactaattttcgtgcatttgttactactgagtttcttaatatctgactggcctccgcccacgggctctgcagagcataaatactcaggctgatggtagtgcagagactctccctccttgatcagcgcaaacgttggtctgaggcttgagggatggagcaacattttcttggctgtgtgaagcgggcttgggattccgcagaggtggcgccagagccccagcctccacctattgtgagttcagaagatcgtgggccgtggcctcttcctttgtatccagtactaggagagtactcactggacagctgtgatttgggactgctttccagcccttgctggcggctgcccggagtctactggcaaaacggactctctcctggagtccagagcaccttggaaccaagtacagcgaagcccactgagttcagttggccggggacacagaagcagcaagaggcacccgtagaagaggtggggcaggcagaggaacccgacagactcaggctccagcagcttccctggagcagtcctctccatccctgggacagacagcaggacaccgaggtctgtgacagcgggtgccttttggaacgccgccatcctcctgccctccagccgtggcgccacctcccgggtttctcagactgcctggagtggattcttcgcgttggttttgccgcgttctctgtactctgggcgtgctgttcacggatctgtggagctaagcagccttagatagcagcagaaggctttttggattctcctccttgaaaagattctcagttaccaaacgtctccacctagaaaataaaaatacattaagatgtgctttcaaacaaaaacacaaaacagagaaaaaaaacaaaaaaaaaaaacaaaacagagggcggcggcgcgcgccctatcaagaatctctccccgcggggggagcccccaacaacgtggcgcgcggtgaacacaaagttgttccgtagcaacacaagggggggcccccccatagtaggagccggccgacatagaacaagagaagaaggaacgatgtgcgaccacgtgatcaacaaccagcgcctccgatggacgtggggagcaaacacgtggcaacgccgggaaacactcgacgcggggagcgaagacctacagaccagagggggaggcgcacaaatcgtgggcgacaactgcc

SEQ ID NO: 293428 - DNA, 199 bp, Homo sapiens
  misc_feature (30)..(30): n is a, c, g, or t
gatcaactttaaaagaacttggaagtacantcctcaagcgtttctggaaatagcagaactacaatatttgagaaaaatattttttaatgtataaaaaattggcagggtaggctagcaagcaagagacctagagaaaagttgatgttacagtctcaagtcgaaaggcaatctgcaggcagaattatttccttgagggatc

SEQ ID NO: 293429 - DNA, 5137 bp, Homo sapiens
  misc_feature (5116)..(5116): n is a, c, g, or t
cgcgacgccccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcaggggagaggagaggcctgatggggcagagctggacgaagtctgctaagagagatggaggctgtggcggactccttccaactcacgatttatcctcagctcagagtgtattttgaatatgagcaaatgtttattcaatcttcaagaagtatcaagtccatccaggcgcggtggcttacacctgtaatcccaggctttgggaggccgaggcagccggatcatgaggtcaggagatcgagaccatcctggctaacacggtgaaaccccatctctgtattttgtatttgtaaaaatacaaaaaattacctgagcgtggtggcacgcacctgtagtcccggctactcaggaggctgaggcaggagaatcacttgaacccgggaggcggaggttgcagtgagccaagatcatgccgctgcactccagcctgggngacagagcaagactccatctc

SEQ ID NO: 293430 - DNA, 863 bp, Homo sapiens
cgcgacgccccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagatatccttttgaaagttctcttttttaacgttcaagaagtttgactatttctttttttttttgagacgaaatctcgctcttgtcgcctaggctgcagtgcaatggtgcgatttcagttcaccgcaacctccacctcccggttcaagcgattctcctacctcagcctcccgagtagctgggattacaggcacccaccaccaggcccagctaattttcgtatttttagtagagacggggtttcaccttgttggccaggctggtcttgaactcctgacctcaggtgatctgcctgccttggcctcccaaagtgctaggattacaggtgtgagccaccgtgcctggccagaagtttgactatttcatgaagacaatgtaaactccagag

SEQ ID NO: 293431 - DNA, 4870 bp, Homo sapiens
cgcgacgccccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgtttattgaagtcaaactgtgatggctggctgcttggaacatcatcatctattaaaaagcaccaagaccccccaaacagtggagagaataggaaggagaggaagacagttgggtttcattcgcatatgaaagatgatgcccagtggtcatgtcaaaagaaagatacatgtagaccccaaagagggacagtgacaggagttagaaaagatgcgtctacatctcctatgccaacaggaagcctaaaggattttgtcaccacagcctcaccatcattacagcacaccacctcccggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaacaacccaggttattttcaatcagaccaggcattcgataacacactaagggggtaggaatggaagatggtatcttttatatgctaaacagattagaaaattaacataggatactttctgcgtggtggaaaccattgcatattcagcctcatttcaagagtgtttccttctcaaacttctgctagaaaatgctgactcacttttatatacaagaaaaacctttccactgaaaaatccctctgatttaaaagtaacccctttgaaacataagcagtttcagaaaggcagactctctcatctttctcatcctgttctctcactactacatttctgtaagtggtcctttaattctgaagttggagttggtgcccctgccatcacaaacaacacgagagccaattgtgagtcagtctcagtagccatcagcctggcagctgcccatcccataaccaaagagctcaatgggctggagggtgagacccagccaatccttgggagcaagcagcactaaatcacatcagggagtgattagtcctggggaaattcagtggaggcacaagcctgaagcactcttctaccaatgtttgggtgaccacccctccaatatcccagaatgaataagaacaatccctaggtatttttatttacccaagtgttcagcttattcaccccacccccccaccccccatcacacgtgctcctgtgaactttccatggttatgtctacggaaaatgccactagagagagagtgatgcaagctgctgcaaagctgatgggcttcctctggccctcccttttcctccacgaggattaaaggatacaagctgaccaggcctcacaggtgctctgctcgtggccccaaagaaccatctctacttgccagagtatgttccaccacccaagcagggtctccctactttttctcactggcctcgttttgacccagagaaagcctatggaagttatgcagtgcagacctcatcctgtctgctgtcttttctcccacagagctcttgagatgggtccttcagcttgcagtggtccctagtagcctctcaagctaatggggatgatgatcctggtttagccagagttcaaaactctccagtcattgaaagcaaggggagggtgtgttcccagatgtgtattacttgggaattttatttgatctggagggtgtggctttttttctctcctttttaccaaccccaactaaactgggagtaagacttagtcagtgttggtagacaaagtcataccacccagggcagcctgcatgcagcgagtctgcgtggcttccctgaattactcttttaattaaaactagattatttcaatctagaaaagccttgttgagcagcctccttatccagatagatccaaagctcatgtctcttcaggctgagactggcgctgtcacctccacccagccttctttcacttggggttttttattctttggagtagaaaagaatggagcccactaatattatatttttcttctgaaataaatataaagtcaagactaactagttataatcattcccttaaaaagttggaaaatcattacagattaaaatttctttataaagttcacctctgagagtaaccaaatcggtttcatcccatatcaaaaagcctttggagtgtggagctttctgtggtatggcagaaatgggtggatggcaaactaagagccctcagccattttttcagttaaagttaggttgccagaactttcttttccttgccccctgtgtcatgactagcttaagtgtacttgactcccatagactactcccatgcccacagtcacccattccagactccagtgtccttaaaactctggagtgagaggatgccagaggatcaagaaaaggatcacagtttcttgaagaagcttgtttgcctttagaagaatcgtaaacagagtctaaactaaaggctttttgggggtcacagccacagagtggagttttattgcttctttgcctctccatgaatggccaatttggaaaagcagagatgggctttcagcagaatatcaaccaatacatttttcacatgcaaaactcatcaccagttgcctttttctaacttaatggacattttgttggtgttggtgcaagggcaataggatgtaaatttgtatataatctaatgtcttcattattaattgaatagtacatgttaacattttaatctatttaaatttactttgaaatatatacatacatatgaatgaaaggttgttacagagcctcaaagctgttgcagactatcccaagagaaaggatctggcacaaaggaatctgcctttcctccgtctcaagtctcccacccttgactggttgggatttgctcgtccagcctctagacacttcccaaagcaagactggacacatgccgagggcgttgcggatagtgcctcaccattgcccaccctgctgcccaactcctgtgagagaaaaaccaatcaatgtttacaaaatggaaaaggacacagcatgtcctttgaactccctaagtaaggcccacagttcttgatgcagagaaccaaagtgaatcatagaaaagcttttgctaacagtccgctttccaggaggcaaacttgtgtttatccaaacctgatccccatgatggggacttttctagagcaccccaaatgtcatggggagagagggactctttctgctccctcagagctactcttcacttgtccctgcttccggcaccaagttcataatagagatcttctggccagagaatcaggggagaggagaggcctgatggggcagagctggacgaagtctgctaagagagatggaggctgtggcggactccttccaactcacgatttatcctcagctcagagtgtattttgaatatgagcaaatgtttatgtacgtatgagatttcaagttaataaatcatctctatggctattttcccc

SEQ ID NO: 293432 - DNA, 433 bp, Homo sapiens
ctgggcttcttgaattctcattttctaataatctgatcctttcctgtctgggttatatgtcttacaggtatgagacatctttgttggatttggttcagtctctgagcccaaactctgcgcccaaacctcagcgctatccctccagagaagctggggcctggaatcatggtactttccgactcagtcctctaaaatcaacccggaagaagatggggatgcacagaacccctgaagagttggaggagaatcagattctggaagatatatttttcatttgacatattgcaaaattttcttaggaaatttgtgggtttcctcacatactgatctaggattttaaattatttcattgcaaagtaattgtgtctctcctttcacggggacttgtctcactagcatcctgttacgtattgaatatagaaatcattctaac

SEQ ID NO: 293433 - DNA, 1577 bp, Homo sapiens
aggtgatcttgtggttctttctaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattgctcagagtagtttgatcatctgaatccttctctcaactcgtcaaagtcattctctgtccagctttgttccgttgctggtgaggagctgcgttcctttggaggaggagaggtgctctgctttttagagtttccaagaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggttgggttacccacaaagggaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttctcaccaccagacttgccctaaaagagctcctgaaggaagcactaaacatggaaaggaacaactggtaccagctgctgcaaaatcatgccaaaatgtaaagaccatcaaggctaggaagaaactgcatcaactaacgagcaaaataaccagctaacatcataatgacaggaacaaattcacacataacaatattaactttaaatgtaaatggactaaatgctccaattaaaagacacagactggcaaattggataaagagtcaagacccatcagtgtgctgttttcaggaaacccatctcacatgcagagacacacataggctcaaaataaaaggatggaggaagatctaccaagc

SEQ ID NO: 293434 - DNA, 1692 bp, Homo sapiens
cgcgacgccccgagtggcggttgtttcaagatggcggacgtggcgggcccctcccgccccagtgccgcggcgttctggagccgggacttttctgatgaagaacaatcagtagtatacgttccaggaatttctgctgaaggaaatgtcagatcaagacacaagctgatgagtccaaaagctgatgttaaacttaagacttccagggtgactgatgcttcaatctccatggagtccttaaaaggcacaggagattcagtagatgaacagaattcctgcaggggagaaataaagagtgcatcattgaaggatttatgtcttgaagacaaaagacgcattgcaaacttaattaaagaactggccagagtaagtgaggaaaaggaagtgacagaggaaagactgaaagctgagcaggagtcatttgagaagaagatcaggcagttggaagaacagaatgaactgatcatcaaagaaagggaagctcttcagctacagtatagagaatgccaagaacttctaagcctgtatcagaaatatttatcagaacaacaggagaagctcaccatgtctctctcagaacttggtgctgctagaatgcaggaacagcaggtatccagtagaaaaagcactctccagtgttcatctgtggaactggatggttcctacttgagcatagccagaccacagacctactatcaaaccaagcaaagacctaagtctgcagtccaggattcagcttcagaatcccttatagcatttaggaataattctttgaaaccagtaacccttcatcatcccaaagatgatctagataagataccatcagagaccacaacatgtaattgtgaatctccagggagaaaacctgcagtcccaacagagaaaatgccacaagaagaattgcacatgaaggaatgtccacatcttaagcctactcctagtcaatgctgtggtcatagacttgctgcagatcgtgttcatgacagccatcctacaaacatgacccctcaacatcctaagacacatccagaatcatgcagttattgtcggctttcttgggcatctctggtgcatggtggtggggcactgcaacccattgaaactttgaaaaagcagatctcagaagatagaaagcagcaactgatgcttcagaaaatggaactggaaattgaaaaggagcgccttcagcatctgctggcccagcaggagacaaagcttcttctaaaacagcagcagcttcaccagtctcgactggattacaattggttaaaagctcaggctctgtttaagtcgagagaactggttgctgaaaaacagcttactaaaccccaagaactcaaactggatatgaatggcagtgactctggaccaaggtaaacctgaagtctcagttaaaacaagaatcttaagggcataaatatttaggatacgtttggtatacttttatagctctatgttgattaatacagttttgtgaccatatgaatacgtacattcctgttatacaattttgaaaaatatagaaaaatatgaaaaacaaaataaaaatcattcataatcctacaactttgagagaatcttttgagcccttttctactatttcttttttgttttttgttttttttttttttttggtgcggtattatagtctatattgagtattaaggattatgcttatacagaattttatgttac

SEQ ID NO: 293435 - DNA, 493 bp, Homo sapiens
agctgatttttcagtgaacatgtttttattgaacaccaacttaatttcaggaacatttcaggtacattgtcagaaataaagactcttaagaatgtattattatgtacccaatactggtttcaggcctttacatgtattctcatgaaactctatgaagtagatattattatcaatattcctactttacagatgaggaaacccaggcctggagaggtcaagcaacttgctcaagtggcacagctggagagtggggagctgggacttgagcccaggtagtgtgtccccagcaccttcaactaaactccattctgtgctgccctttggaacacccactcaatggccttcacactccatgtcctacttgggaggacatgtgatctcaacagcactcacaaatgaaggctttccagacaggatattgaagatggtaagatcagtctcatgtataaagcattttttaaaagtaaagcatattatatgctagtcatatgta

SEQ ID NO: 293436 - DNA, 651 bp, Homo sapiens
agctgatttttcagtgaacatgtttttattgaacaccaacttaatttcaggaacatttcaggtacattgtcagaaataaagactcttaagaatgtattattatgtacccaatactggtttcaggcctttacatgtattctcatgaaactctatgaagtagatattattatcaatattcctactttacagatgaggaaacccaggcctggagaggtcaagcaacttgctcaagtggcacagctggagagtggggagctgggacttgagcccaggtagtgtgtccccagcaccttcaactaaactccattctgtgctgccctttggaacacccactcaatggccttcacactccatgtcctacttgggaggacatgtgatctcaacagcactcacaaatgaaggctttccagacaggatattgaagatgggaggtgtgagctgtgggagagagctgactaagaagaagaaactccccagaaaggtggcctgccagtcttcacgatgtatgggagcaggtgggaaaagagctgcaagtgtttgcacttcatcattgaaattgttgaaactgctgatcaggaaacacagaatgagtttaaccagcgatgccaacttctgcaagatggactccagcttgggagctctgtatggaat

SEQ ID NO: 293437 - DNA, 1516 bp, Homo sapiens
taatttttttttgagtactgaaacctttattcccattttactggaaacaaagaacatgaacaatttactagtcagaaaaaaagtgttttataacccaaaacaaatatttgccaagagctgtaaattgcttaaatcgcttaaactggagatttcagtgagatttttagcagtagattactaagctccttagttatagaacattcaatgcataggaaagtgtttttcctacaaagcataactgaaatgtagtttaactaatggtttacaattcagtcaaataccaaagctgcaaaccatttagggagtcatcaattacatattttgtacactttcaaaaagcttacagctgggatgggttgtttattttcaaagcatgactgctttaaaatgatcatattctttagcctgccacctaggaagcattaagcatttacttgcagaatgaacaaacgagcacgttgtcttgtgttatgaagtatataatatagttcgttttagtttcttcattcgcagactatcaggctcatttcacgtgactgcttgcacttagaactgagttatcacggagtaggaactctccaacatcgtcgtcatagaccaagagatgcccatgaacagccatgaaagtgccagtcagggaagtattcagtgctttgttgtagagttgttggatagaggcacaggatcatttcatgttgttgaggagaaaggagcaacagcctcctcccaccttattaaaaatagagatttaaaaaaacctctaatttcctcgaagtacagaatctcaagaggtagctctaaggagaatccctctgggtttgagcgcattcctcttccagggggcctattcttggactgctttccttaatagagaaatctctctgagccaaaatcggcctcccccaattccatcctgtcggccccacttttctgctccggagacttccaagccagtccccactcctccttcagccagtcgggcccgcacccgcgcccggcagggccagccctctcctcctcctgcgtggcgcagcacaggccctgagcgcgcgaccccaggccctgggcgccccgccgcatgctcgcggctggaagccccagtttgcgtggcccttcgggttattccgctcaagagccgccgcgtcgccccatctcggcgcgaatctgaaagcgctttcgggggagaagatgttgggggcactggtgagtacactgcacaagtgacaaaatgttttcagctcctggaggcgaaaggtgcagagtcgctctgtgtccgtgaggccgggcggcgacctcgctcagtcggcttctcggtccgagtccccgggtacgaggaaagaccacagggggcttctcgcggaaaagcgggccgcggaccctgcgcgggctggctggggcgggcggatgacgaggcgcaggggcaagggtgggtctgcgaggcggcgggtccgggcgtcttaggctccggggctccctcgctggcggcggagcagggatggcgcgcccgggggtgagg
